United States Patent
Brevnova et al.

(10) Patent No.: US 10,724,041 B2
(45) Date of Patent: *Jul. 28, 2020

(54) INCREASING LIPID PRODUCTION AND OPTIMIZING LIPID COMPOSITION

(71) Applicant: Novogy, Inc., Cambridge, MA (US)

(72) Inventors: Elena E. Brevnova, Belmont, MA (US); Arthur J. Shaw, IV, Belmont, MA (US); Johannes P. Van Dijken, Leidschendam (NL)

(73) Assignee: NOVOGY, INC., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 15/313,187

(22) PCT Filed: May 29, 2015

(86) PCT No.: PCT/US2015/033211
§ 371 (c)(1),
(2) Date: Nov. 22, 2016

(87) PCT Pub. No.: WO2015/184277
PCT Pub. Date: Dec. 3, 2015

(65) Prior Publication Data
US 2017/0191073 A1    Jul. 6, 2017

Related U.S. Application Data

(60) Provisional application No. 62/090,169, filed on Dec. 10, 2014, provisional application No. 62/004,506, filed on May 29, 2014.

(51) Int. Cl.
| | |
|---|---|
| *C12N 15/81* | (2006.01) |
| *C12N 9/04* | (2006.01) |
| *C12N 9/02* | (2006.01) |
| *C12N 9/10* | (2006.01) |
| *C12N 9/20* | (2006.01) |
| *C12N 15/52* | (2006.01) |
| *C12P 7/64* | (2006.01) |
| *C07K 14/39* | (2006.01) |
| *C12N 9/16* | (2006.01) |

(52) U.S. Cl.
CPC .......... *C12N 15/815* (2013.01); *C07K 14/39* (2013.01); *C12N 9/0006* (2013.01); *C12N 9/0071* (2013.01); *C12N 9/1029* (2013.01); *C12N 9/16* (2013.01); *C12N 9/20* (2013.01); *C12N 15/52* (2013.01); *C12P 7/6409* (2013.01); *C12Y 101/01008* (2013.01); *C12Y 101/01044* (2013.01); *C12Y 101/01049* (2013.01); *C12Y 114/19001* (2013.01); *C12Y 114/19006* (2013.01); *C12Y 203/0102* (2013.01); *C12Y 203/01015* (2013.01); *C12Y 203/01051* (2013.01); *C12Y 203/01199* (2015.07); *C12Y 301/01003* (2013.01); *C12Y 301/03004* (2013.01)

(58) Field of Classification Search
None
See application file for complete search history.

(56) References Cited

U.S. PATENT DOCUMENTS

2003/0233675 A1    12/2003    Cao et al.

FOREIGN PATENT DOCUMENTS

| WO | WO-03053363 A2 * | 7/2003 | .......... C12N 9/1029 |
| WO | WO-20101025374 A2 | 3/2010 | |

OTHER PUBLICATIONS

Boer et al., "An Extracellular Lipase From the Dimorphic Yeast Arxula Adeninivorans: Molecular Cloning of the ALIPI Gene and Characterization of the Purified Recombinant Enzyme," Yeast, 22: 523-535 (2005).
International Search Report for International Application No. PCT/US2015/033211, dated Nov. 6, 2015.
Jankowska et al., "Arxula adeninivorans xanthine oxidoreductase and its application in the production of food with low purine content," J Appl Microbiol, 115: 796-807 (2013).
Kunze et al., "The complete genome of Blastobotrys (Arxula) adeninivorans LS3—a yeast of biotechnological interest," Biotechnology for Biofuels, 7(66): 1-15 (2014).

* cited by examiner

*Primary Examiner* — Robert A Zeman
(74) *Attorney, Agent, or Firm* — Albert Shung

(57) ABSTRACT

Disclosed are nucleotide sequences and corresponding amino acid sequences of *Arxula adeninivorans* genes that can be utilized to manipulate the lipid content and/or composition of a cell. Methods and compositions for utilizing this information are disclosed to increase the lipid content or modify the lipid composition of a cell by either increasing or decreasing the activity of certain genetic targets.

8 Claims, 9 Drawing Sheets
Specification includes a Sequence Listing.

A

B

C

D

INCREASING LIPID PRODUCTION AND OPTIMIZING LIPID COMPOSITION

PRIORITY CLAIM

This application claims the benefit of priority to U.S. Provisional Patent Application No. 62/004,506, filed May 29, 2014; and U.S. Provisional Patent Application No. 62/090,169, filed Dec. 10, 2014.

SEQUENCE LISTING

The instant application contains a Sequence Listing which has been submitted electronically in ASCII format and is hereby incorporated by reference in its entirety. Said ASCII copy, created on May 18, 2015, is named NGX-03325_SL.txt and is 657,774 bytes in size.

BACKGROUND

Lipids are indispensable ingredients in the food and cosmetics industries, and they are important precursors in the biodiesel and biochemical industries. Many oleaginous microorganisms produce lipids, including the well-characterized yeast *Yarnnwia lipolytica*.

*Arxula adeninivorans* (*Blastobotrys adeninivorans*) is an oleaginous yeast that is less well characterized than *Y. lipolytica*. In fact, currently, there are no industrial *A. adeninivorans*-based processes, perhaps because *Arxula adeninivorans* is a yeast with a number of unusual characteristics. It is dimorphic and can utilize a wide range of substrates as sources of carbon, nitrogen, phosphorous, and energy, including starch, xylose, acetic acid, ethanol, arabinose, cellobiose, phytic acid, adenine, xanthine, uric acid, putrescine, and n-alkylamines. *A. adeninivorans* is also nitrate-assimilating and thermo- and osmo-tolerant. A distinctive feature is its ability to grow efficiently at 37'C, and a temperature-dependent dimorphism with mycelial structures formed at temperatures above 42'C.

SUMMARY

Disclosed are nucleotide sequences and corresponding amino acid sequences of *Arxula adeninivorans* genes that can be utilized to manipulate the lipid content and composition of a cell. Methods and compositions for utilizing this information are disclosed to increase the lipid content or modify the lipid composition of a cell by either increasing or decreasing the activity of certain genetic targets.

denotes the *S. cerevisiae* origin of replication from the 2 μm circle plasmid; "pMB1 ori" denotes the *E. coli* pMB1 origin of replication from the pBR322 plasmid; "AmpR" denotes the bla gene used as a marker for selection with ampicillin; "PR3" denotes the *Y. lipolytica* TEF1 promoter −406 to +125; "NG16" denotes the native *Y. lipolytica* DGA2 gene amplified from gDNA of *Y. lipolytica* strain NRRL YB-437; "TER1" denotes the *Y. lipolytica* CYC1 terminator 300 bp after stop; "PR1" denotes the *Y. lipolytica* TEF1 promoter −406 to −1; "NG76" denotes the *Streptoalloteichus hindustanus* BLE gene used as marker for selection with Zeocin; "TER7" denotes the *Y. lipolytica* TEF1 terminator 400 bp after stop; and "Sc URA3" denotes the *S. cerevisiae* URA3 auxotrophic marker for selection in yeast.

Figure 7:
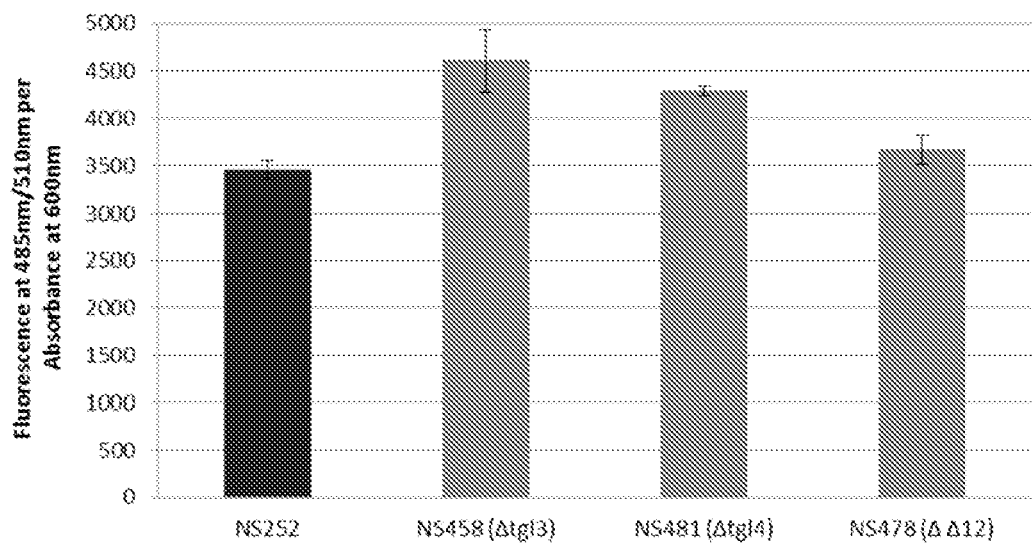

FIG. 7 depicts the relative lipid contents of wild type *Arxula adeninivorans* (strain NS252), *Arxula adeninivorans* strain NS458, which comprises a TGL3 knockout, *Arxula adeninivorans* strain NS481, which comprises a TGL4 knockout, and *Arxula adeninivorans* strain NS478, which comprises a Δ12 desaturase knockout, as assessed by a fluorescence-based lipid assay. The TGL3 and TGL4 knockouts each comprise a higher lipid content than the wild type strain.

Figure 8:
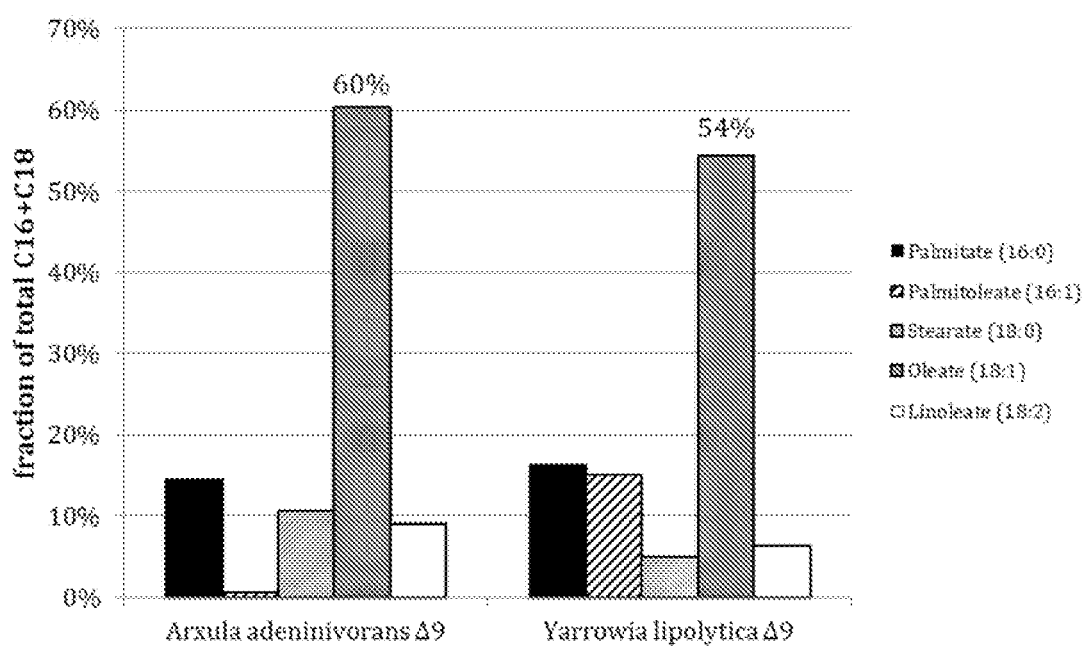

FIG. 8 depicts the percentage of C16 and C18 fatty acids that are palmitate, palmitoleate, stearate, oleate, and linoleate for *Y. lipolytica* strains expressing either the *A. adeninivorans* or *Y. lipolytica* Δ9 desaturase gene.

Figure 9:
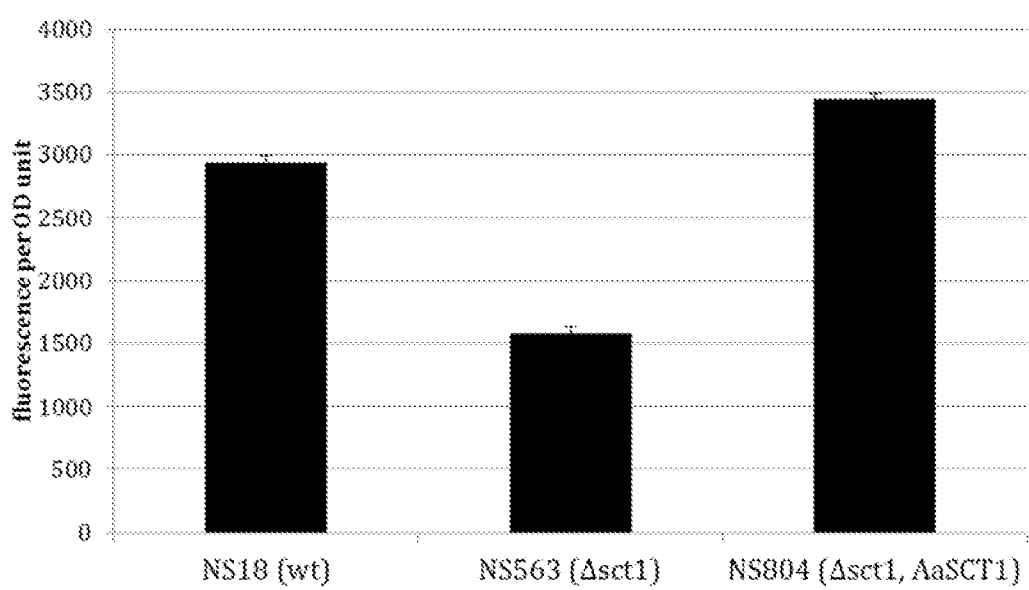

FIG. 9 depicts lipid accumulation as measured using a fluorescence-based assay for *Y. lipolytica* strains NS18 (wild type), NS563 (deletion of *Y. lipolytica* SCT1) and NS804 (*A. adeninivorans* SCT1) overexpression in the NS563 background). Strains were grown in duplicate in 96-well plates.

Figure 10:
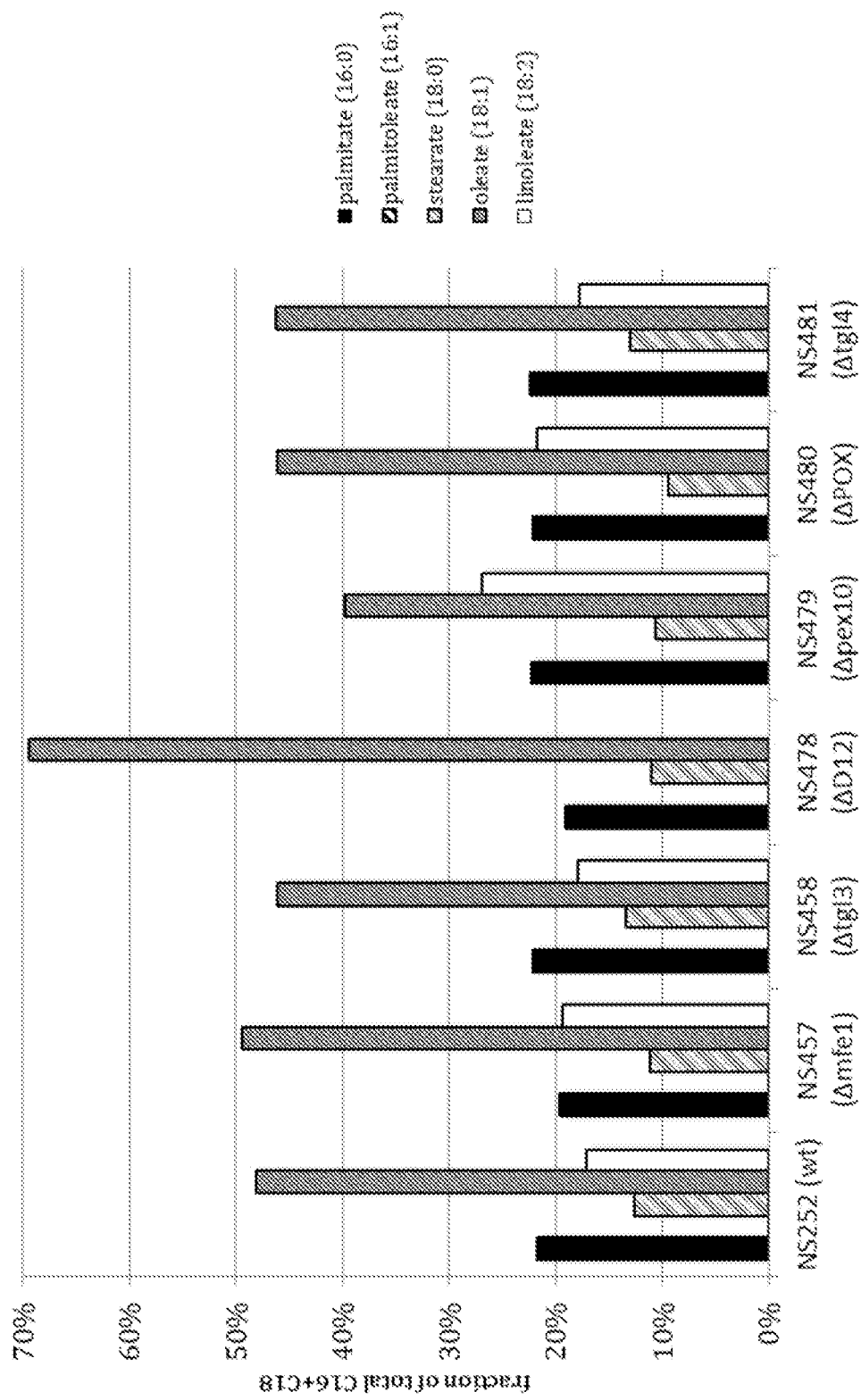

FIG. 10 depicts the percentage of C16 and C18 fatty acids that are palmitate, palmitoleate, stearate, oleate, and linoleate for *A. adeninivorans* strains carrying deletions of the native MFE1TGL3, Δ12, PEX10, POX, and TGL4 genes.

Figure 11:
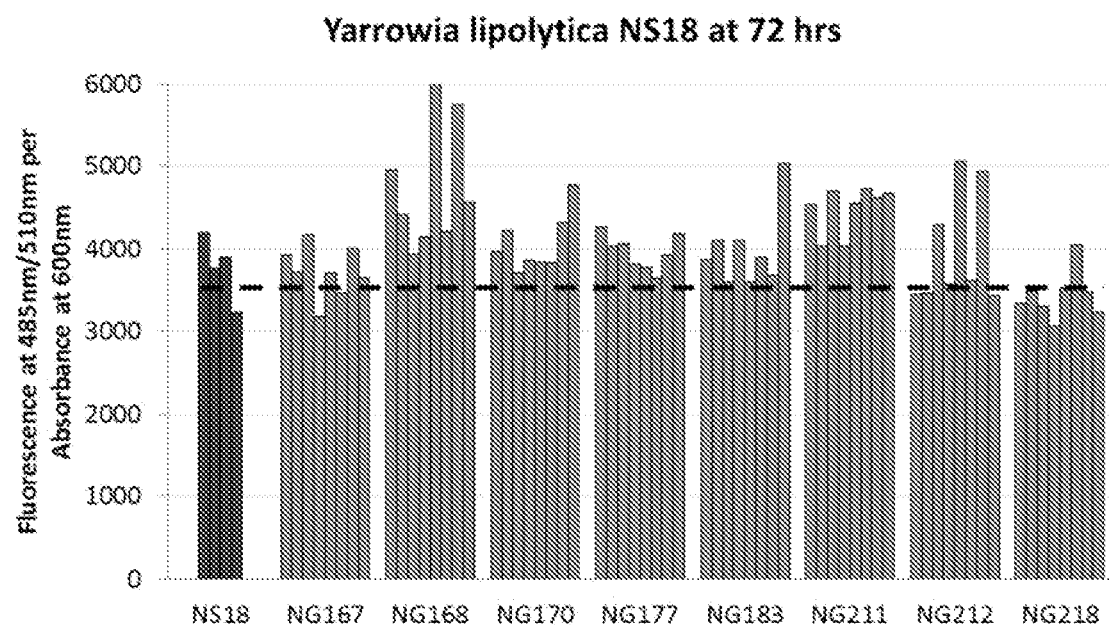
Figure 11:
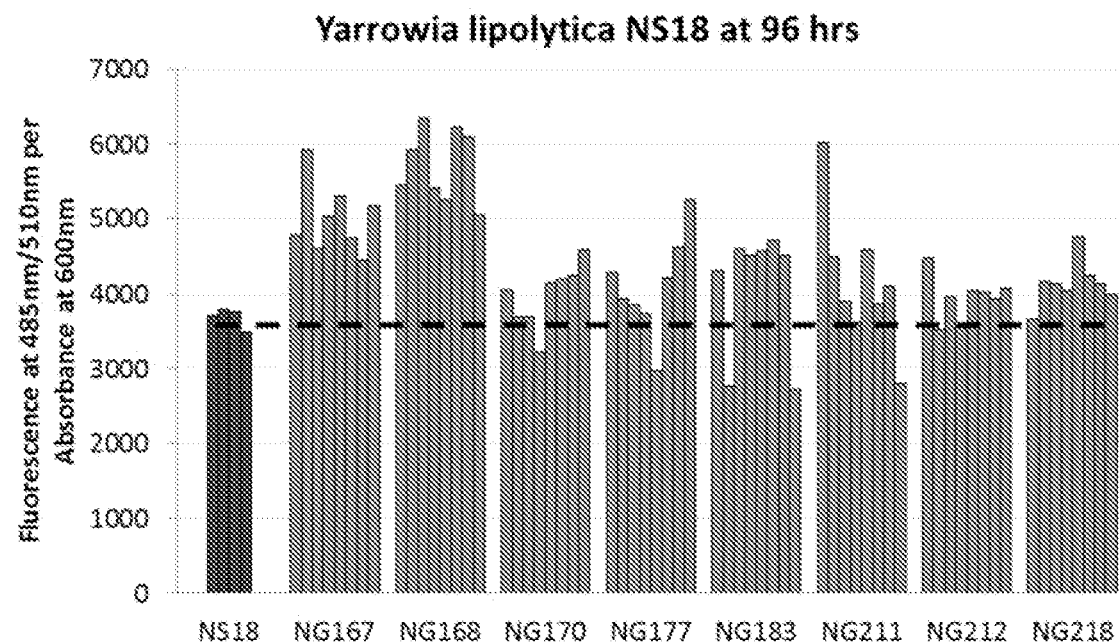
Figure 11:
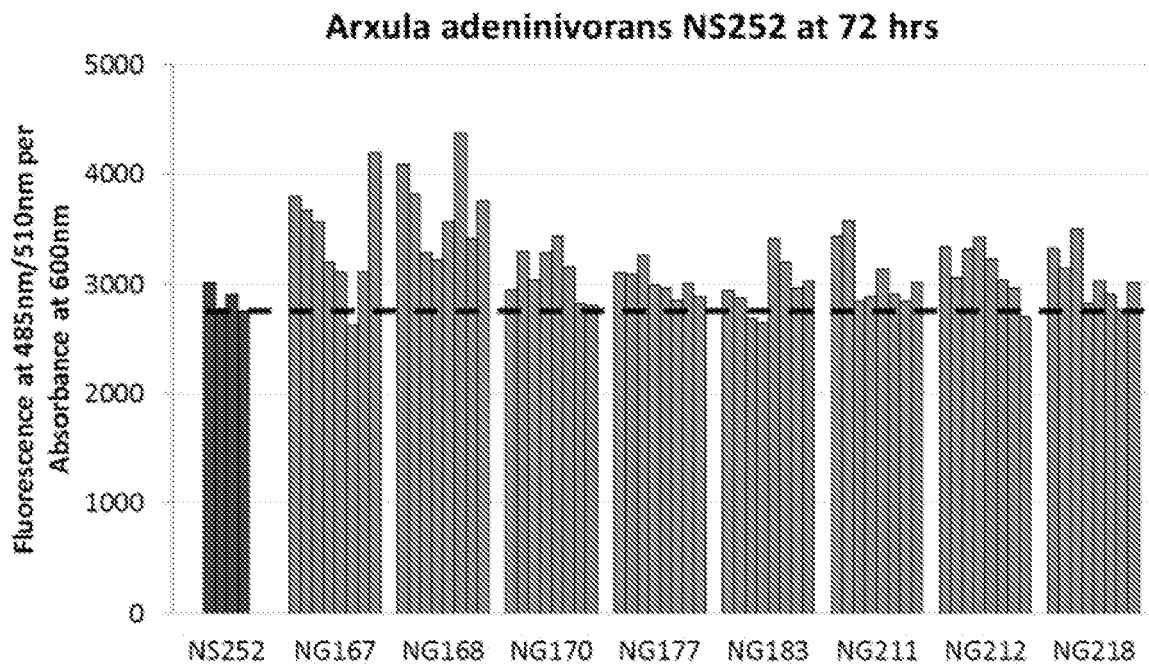
Figure 11:
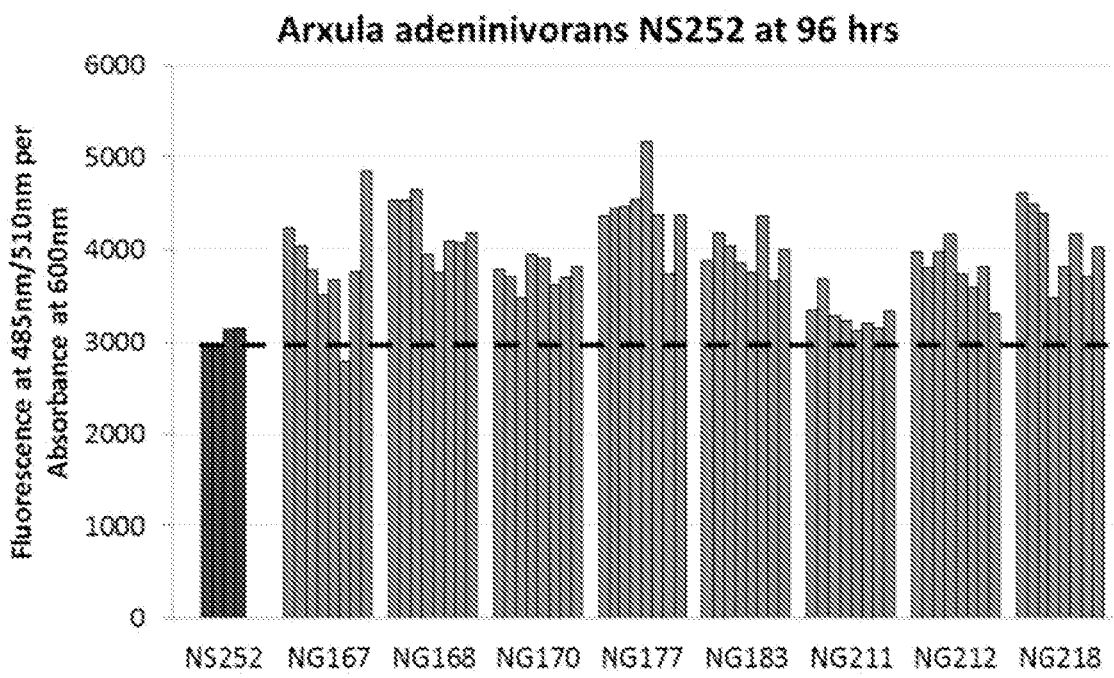

FIG. 11 consists of four panels, labeled panels (A), (B), (C), and (D). The panels depict results from a 96-well plate lipid assay for *Y. lipolytica* (panels (A) and (B)) and *A. adeninivorans* (panels (C) and (D)) transformants with randomly integrated *Arxula adeninivorans* genes DGA1 (NG167), DGA2 (NG168), GPD1 (NG170), SLC1 (NG177). SCT1 (NG183), ZWF1 (NG211), GND1 (NG212), and PAH1 (NG218).

Figure 12:
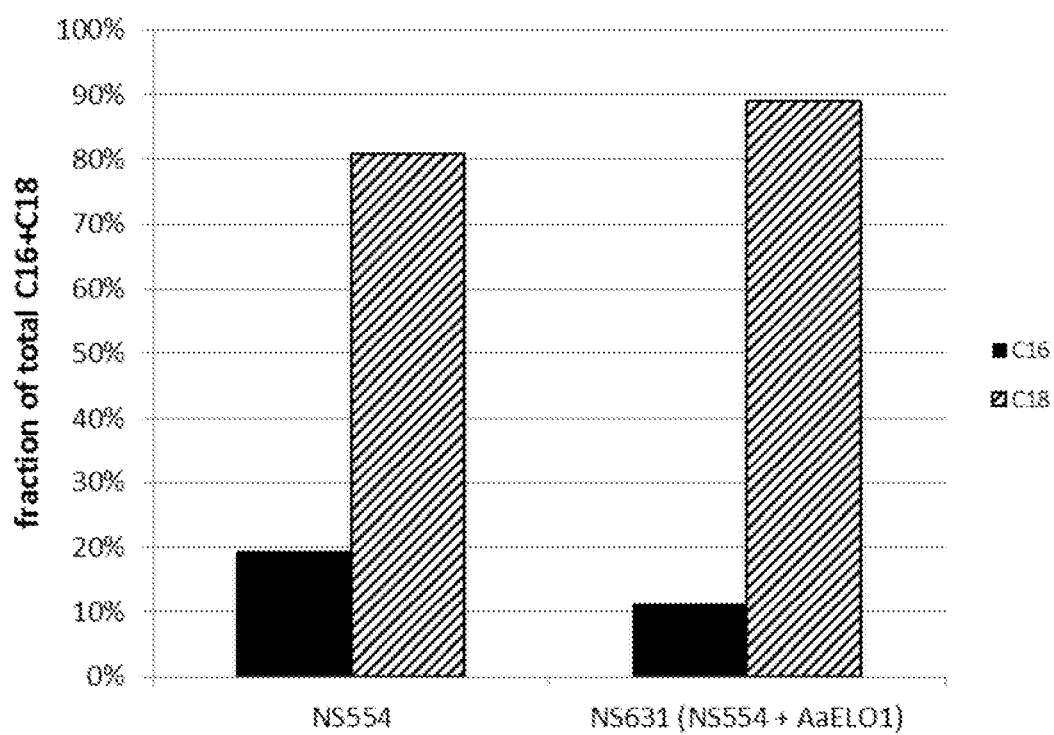

FIG. 12 depicts the relative proportion of C16 and C18 fatty acids for *Arxula adeninivorans* strain NS554 (Δ12 knockout in wild type *Arxula adeninivorans* strain NS252) and NS631 (*Arxula adeninivorans* ELO1 overexpression in a NS554 background). The expression of *Arxula adeninivorans* ELO1 in a Δ12 knockout increased the fraction of C18 fatty acids.

DETAILED DESCRIPTION

Overview

Many strategies exist to increase or modify the lipid production or content of oleaginous organisms by genetic engineering. However, most oleaginous organisms grow relatively slowly at mesophylic temperatures, and many require additional engineering to utilize pentose sugars. The oleaginous yeast *Arxula adeninivorans* has the potential to generate lipids from various substrates with fast growth at high temperature, which may result in reduced biorefinery operating and capital expenses as well as a reduced risk of microbial contamination.

The lipid yield and lipid composition of an oleaginous organism can be modified by up-regulating and/or down-regulating or deleting genes that are involved in or regulate various lipid pathways. In addition to the manipulation of native genes, exogenous genes can be introduced into the host genome to modulate lipid production and composition.

This invention describes compositions and methods to produce lipids by engineering *A. adeninivorans*, and these compositions and methods are generally applicable to other organisms to increase lipid production levels and to change an organism's lipid-composition profile. The method of increasing lipid production levels involves up-regulating genetic targets that have a positive effect on lipid content and down-regulating targets that have a negative effect on lipid content. Similarly, the method of changing a lipid-composition profile involves up-regulating genetic targets that have a positive effect on a particular fatty acid of interest and down-regulating targets that have a negative effect on the particular fatty acid. For example, genetic targets can be modified to increase the palmitic acid, palmitoleic acid, stearic acid, oleic acid, or linoleic acid content of a cell. The genetic targets can be modified to increase the concentration of lipids, triacylglycerides, fatty alcohols, fatty acids, alkanes, alkenes, isoprenoids, isoprene, squalene, farnasene, alcohols, isopropanol, n-propanol, n-butanol, isobutanol, 2-butanol, butadiene, diols, 1,3 propanediol, 1,4 propanediol, succinic acid, adipic acid, nylon precursors, citric acid, malic acid, polyols, or erythritol in the cell.

Definitions

The articles "a" and "an" are used herein to refer to one or to more than one (i.e., to at least one) of the grammatical object of the article. By way of example, "an element" means one element or more than one element.

The term "activity" refers to the total capacity of a cell to perform a function. For example, a genetic modification that decreases the activity of a triacylglycerol lipase in a cell may reduce the amount of triacylglycerol lipase in a cell or reduce the efficiency of triacylglycerol lipase. A triacylglycerol lipase knockout reduces the amount of triacylglycerol lipase in the cell. Alternatively, a mutation to a triacylglycerol lipase gene may reduce the efficiency of its triacylglycerol lipase protein product with little effect on the amount of cellular triacylglycerol lipase. Mutations that reduce the efficiency of triacylglycerol lipase may affect the active site, for example, by changing one or more active site residues; they may impair the enzyme's kinetics, for example, by sterically blocking substrates or products; they may affect protein folding or dynamics, for example, by reducing the proportion of properly-folded enzymes; they may affect protein localization, for example, by preventing the lipase from localizing to lipid particles; or they may affect protein degradation, for example, by adding one or more protein cleavage sites or by adding one or more residues or amino acid sequences that target the protein for proteolysis. These mutations affect coding regions. Mutations that decrease triacylglycerol lipase activity may instead affect the transcription or translation of the gene. For example, mutation to a triacylglycerol lipase enhancer or promoter can reduce triacylglycerol lipase activity by reducing its expression. Mutating or deleting the non-coding portions of a triacylglycerol lipase gene, such as its introns, may also reduce transcription or translation. Additionally, mutations to the upstream regulators of a triacylglycerol lipase may affect triacylglycerol lipase activity; for example, the over-expression of one or more repressors may decrease triacylglycerol lipase activity, and a knockout or mutation of one or more activators may similarly decrease triacylglycerol lipase activity. A genetic modification that increases the activity of a diacylglycerol acyltransferase in a cell may increase the amount of triacylglycerol acyltransferase in a cell or increase the efficiency of diacylglycerol acyltransferase. For example, the genetic modification may simply insert an additional copy of diacylglycerol acyltransferase into the cell such that the additional copy is transcribed and translated into additional functional diacylglycerol acyltransferase. The added diacylglycerol acyltransferase gene can be native to the host organism or from a different organism. Alternatively, mutating or deleting the non-coding portions of a native diacylglycerol acyltransferase gene, such as its introns, may also increase translation. A native diacylglycerol acyltransferase gene can be altered by adding a new promoter that causes more transcription. Similarly, enhancers may be added to the diacylglycerol acyltransferase gene that increase transcription, or silencers may be mutated or deleted from the diacylglycerol acyltransferase gene to increase transcription. Mutations to a native gene's coding region might also increase diacylglycerol acyltransferase activity, for example, by preventing interactions with inhibitory proteins or molecules. The over-expression of one or more activators may increase diacylglycerol acyltransferase activity by increasing its expression, and a knockout or mutation of one or more repressors may similarly increase diacylglycerol acyltransferase activity.

The term "biologically-active portion" refers to an amino acid sequence that is less than a full-length amino acid sequence, but exhibits at least one activity of the full length sequence. For example, a biologically-active portion of a diacylglycerol acyltransferase may refer to one or more domains of DGA1 or DGA2 having biological activity for converting acyl-CoA and diacylglycerol to triacylglycerol. Biologically-active portions of a DGA1 protein include peptides or polypeptides comprising amino acid sequences sufficiently identical to or derived from the amino acid sequence of the DGA1 protein, e.g., the amino acid sequence as set forth in SEQ ID NOs: 15, 117, 119, 121, 123, 125, 127, 129, 131 or 133, which include fewer amino acids than the full length DGA1, and exhibit at least one activity of a DGA1 protein. Typically, biologically active portions comprise a domain or motif having the catalytic activity of converting acyl-CoA and diacylglycerol to triacylglycerol. A biologically active portion of a DGA1 protein can be a polypeptide which is, for example, 262 amino acids in length.

The term "DGAT1" refers to a gene that encodes a type 1 diacylglycerol acyltransferase protein, such as a gene that encodes a DGA2 protein.

The term "DGAT1" refers to a gene that encodes a type 2 diacylglycerol acyltransferase protein, such as a gene that encodes a DGA1 protein.

"Diacylglyceride," "diacylglycerol," and "diglyceride," are esters comprised of glycerol and two fatty acids.

The terms "diacylglycerol acyltransferase" and "DGA" refer to any protein that catalyzes the formation of triacylglycerides from diacylglycerol. Diacylglycerol acyltransferases include type 1 diacylglycerol acyltransferases (DGA2), type 2 diacylglycerol acyltransferases (DGA1), and all homologs that catalyze the above-mentioned reaction.

The terms "diacylglycerol acyltransferase, type 1" and "type 1 diacylglycerol acyltransferases" refer to DGA2 and DGA2 orthologs.

The terms "diacylglycerol acyltransferase, type 2" and "type 2 diacylglycerol acyltransferases" refer to DGA1 and DGA1 orthologs.

The term "domain" refers to a part of the amino acid sequence of a protein that is able to fold into a stable three-dimensional structure independent of the rest of the protein.

The term "drug" refers to any molecule that inhibits cell growth or proliferation, thereby providing a selective advantage to cells that contain a gene that confers resistance to the drug. Drugs include antibiotics, antimicrobials, toxins, and pesticides.

"Dry weight" and "dry cell weight" mean weight determined in the relative absence of water. For example, reference to oleaginous cells as comprising a specified percentage of a particular component by dry weight means that the percentage is calculated based on the weight of the cell after substantially all water has been removed.

The term "encode" refers to nucleic acids that comprise a coding region, portion of a coding region, or compliments thereof. Both DNA and RNA may encode a gene. Both DNA and RNA may encode a protein.

The term "exogenous" refers to anything that is introduced into a cell. An "exogenous nucleic acid" is a nucleic acid that entered a cell through the cell membrane. An exogenous nucleic acid may contain a nucleotide sequence that exists in the native genome of a cell and/or nucleotide sequences that did not previously exist in its genome. Exogenous nucleic acids include exogenous genes. An "exogenous gene" is a nucleic acid that codes for the expression of an RNA and/or protein that has been introduced into a cell (e.g., by transformation/transfection), and is also referred to as a "transgene." A cell comprising an exogenous gene may be referred to as a recombinant cell, into which additional exogenous gene(s) may be introduced. The exogenous gene may be from the same or different species relative to the cell being transformed. Thus, an exogenous gene can include a native gene that occupies a different location in the genome of the cell or is under different control, relative to the endogenous copy of the gene. An exogenous gene may be present in more than one copy in the cell. An exogenous gene may be maintained in a cell as an insertion into the genome (nuclear or plastid) or as an episomal molecule.

The term "expression" refers to the amount of a nucleic acid or amino acid sequence (e.g., peptide, polypeptide, or protein) in a cell. The increased expression of a gene refers to the increased transcription of that gene. The increased expression of an amino acid sequence, peptide, polypeptide, or protein refers to the increased translation of a nucleic acid encoding the amino acid sequence, peptide, polypeptide, or protein.

The term "gene," as used herein, may encompass genomic sequences that contain introns, particularly polynucleotide sequences encoding polypeptide sequences involved in a specific activity. The term further encompasses synthetic nucleic acids that did not derive from genomic sequence. In certain embodiments, the genes lack introns, as they are synthesized based on the known DNA sequence of cDNA and protein sequence. In other embodiments, the genes are synthesized, non-native cDNA wherein the codons have been optimized for expression in *Y. lipolytica* based on codon usage. The term can further include nucleic acid molecules comprising upstream, downstream, and/or intron nucleotide sequences.

The term "genetic modification" refers to the result of a transformation. Every transformation causes a genetic modification by definition.

The term "homolog", as used herein, refers to (a) peptides, oligopeptides, polypeptides, proteins, and enzymes having amino acid substitutions, deletions and/or insertions relative to the unmodified protein in question and having similar biological and functional activity as the unmodified protein from which they are derived, and (b) nucleic acids which encode peptides, oligopeptides, polypeptides, proteins, and enzymes with the same characteristics described in (a).

"Inducible promoter" is a promoter that mediates transcription of an operably linked gene in response to a particular stimulus.

The term "integrated" refers to a nucleic acid that is maintained in a cell as an insertion into the genome of the cell, such as insertion into a chromosome, including insertions into a plastid genome.

"In operable linkage" is a functional linkage between two nucleic acid sequences, such a control sequence (typically a promoter) and the linked sequence (typically a sequence that encodes a protein, also called a coding sequence). A promoter is in operable linkage with a gene if it can mediate transcription of the gene.

The term "knockout mutation" or "knockout" refers to a genetic modification that prevents a native gene from being transcribed and translated into a functional protein.

The term "native" refers to the composition of a cell or parent cell prior to a transformation event. A "native gene" refers to a nucleotide sequence that encodes a protein that has not been introduced into a cell by a transformation event. A "native protein" refers to an amino acid sequence that is encoded by a native gene.

The terms "nucleic acid" refers to a polymeric form of nucleotides of any length, either deoxyribonucleotides or ribonucleotides, or analogs thereof. Polynucleotides may have any three-dimensional structure, and may perform any function. The following are non-limiting examples of polynucleotides: coding or non-coding regions of a gene or gene fragment, loci (locus) defined from linkage analysis, exons, introns, messenger RNA (mRNA), transfer RNA, ribosomal RNA, ribozymes, cDNA, recombinant polynucleotides, branched polynucleotides, plasmids, vectors, isolated DNA of any sequence, isolated RNA of any sequence, nucleic acid probes, and primers. A polynucleotide may comprise modified nucleotides, such as methylated nucleotides and nucleotide analogs. If present, modifications to the nucleotide structure may be imparted before or after assembly of the polymer. A polynucleotide may be further modified, such as by conjugation with a labeling component. In all nucleic acid sequences provided herein, U nucleotides are interchangeable with T nucleotides.

The acronym "ORF" stands for open reading frame.

The term "parent cell" refers to every cell from which a cell descended. The genome of a cell is comprised of the parent cell's genome and any subsequent genetic modifications to its genome.

As used herein, the term "plasmid" refers to a circular DNA molecule that is physically separate from an organism's genomic DNA. Plasmids may be linearized before being introduced into a host cell (referred to herein as a linearized plasmid). Linearized plasmids may not be self-replicating, but may integrate into and be replicated with the genomic DNA of an organism.

The term "portion" refers to peptides, oligopeptides, polypeptides, protein domains, and proteins. A nucleotide sequence encoding a "portion of a protein" includes both nucleotide sequences that can be transcribed and/or translated and nucleotide sequences that must undergo one or more recombination events to be transcribed and/or translated. For example, a nucleic acid may comprise a nucleotide sequence encoding one or more amino acids of a selectable marker protein. This nucleic acid can be engineered to recombine with one or more different nucleotide sequences that encode the remaining portion of the protein. Such nucleic acids are useful for generating knockout mutations because only recombination with the target sequence is likely to reconstitute the full-length selectable marker gene whereas random-integration events are unlikely to result in a nucleotide sequence that can produce a functional marker protein. A "biologically-active portion" of a polypeptide is any amino acid sequence found in the polypeptide's amino acid sequence that as less than the full amino acid sequence but can perform the same function as the full-length polypeptide. A biologically-active portion of a diacylglycerol acyltransferase includes any amino acid sequence found in a full-length diacylglycerol acyltransferase that can catalyze the formation of triacylglycerol from diacylglycerol and acyl-CoA. A biologically-active portion of a polypeptide includes portions of the polypeptide that have the same activity as the full-length peptide and every portion that has more activity than background. For example, a biologically-active portion of a diacylglycerol acyltransferase may have 0.1, 0.5, 1, 2, 3, 4, 5, 10, 25, 30, 35, 40, 45, 50, 55, 60, 65, 70, 75, 80, 85, 86, 87, 88, 89, 90, 91, 92, 93, 94, 95, 96, 97, 98, 99, 99.5, 99.6, 99.7, 99.8, 99.9, 100, 100.1, 100.2, 100.3, 100.4, 100.5, 100.6, 100.7, 100.8, 1011.9, 101, 105, 110, 115, 120, 125, 130, 135, 140, 145, 150, 160, 170, 180, 190, 200, 220, 240, 260, 280, 300, 320, 340, 360, 380, 400 percent activity relative to the full-length polypeptide or higher. A biologically-active portion of a polypeptide may include portions of a peptide that lack a domain that targets the polypeptide to a cellular compartment.

A "promoter" is a nucleic acid control sequence that directs transcription of a nucleic acid. As used herein, a promoter includes necessary nucleic acid sequences near the start site of transcription. A promoter also optionally includes distal enhancer or repressor elements, which can be located as much as several thousand base pairs from the start site of transcription.

"Recombinant" refers to a cell, nucleic acid, protein, or vector, which has been modified due to the introduction of an exogenous nucleic acid or the alteration of a native nucleic acid. Thus, e.g., recombinant cells can express genes that are not found within the native (non-recombinant) form of the cell or express native genes differently than those genes are expressed by a non-recombinant cell. Recombinant cells can, without limitation, include recombinant nucleic acids that encode for a gene product or for suppression elements such as mutations, knockouts, antisense, interfering RNA (RNAi), or dsRNA that reduce the levels of active gene product in a cell. A "recombinant nucleic acid" is a nucleic acid originally formed in vitro, in general, by the manipulation of nucleic acid, e.g., using polymerases, ligases, exonucleases, and endonucleases, or otherwise is in a form not normally found in nature. Recombinant nucleic acids may be produced, for example, to place two or more nucleic acids in operable linkage. Thus, an isolated nucleic acid or an expression vector formed in vitro by ligating DNA molecules that are not normally joined in nature, are both considered recombinant for the purposes of this invention. Once a recombinant nucleic acid is made and introduced into a host cell or organism, it may replicate using the in vivo cellular machinery of the host cell; however, such nucleic acids, once produced recombinantly, although subsequently replicated intracellularly, are still considered recombinant for purposes of this invention. Similarly, a "recombinant protein" is a protein made using recombinant techniques, i.e., through the expression of a recombinant nucleic acid.

The term "regulatory region" refers to nucleotide sequences that affect the transcription or translation of a gene but do not encode an amino acid sequence. Regulatory regions include promoters, operators, enhancers, and silencers.

"Transformation" refers to the transfer of a nucleic acid into a host organism or the genome of a host organism, resulting in genetically stable inheritance. Host organisms containing the transformed nucleic acid fragments are referred to as "recombinant", "transgenic" or "transformed" organisms. Thus, isolated polynucleotides of the present invention can be incorporated into recombinant constructs, typically DNA constructs, capable of introduction into and replication in a host cell. Such a construct can be a vector that includes a replication system and sequences that are capable of transcription and translation of a polypeptide-encoding sequence in a given host cell. Typically, expression vectors include, for example, one or more cloned genes under the transcriptional control of 5' and 3' regulatory sequences and a selectable marker. Such vectors also can contain a promoter regulatory region (e.g., a regulatory region controlling inducible or constitutive, environmentally- or developmentally-regulated, or location-specific expression), a transcription initiation start site, a ribosome binding site, a transcription termination site, and/or a poly-adenylation signal.

The term "transformed cell" refers to a cell that has undergone a transformation. Thus, a transformed cell comprises the parent's genome and an inheritable genetic modification.

The terms "triacylglyceride," "triacylglycerol," "triglyceride," and "TAG" are esters comprised of glycerol and three fatty acids.

The term "triacylglycerol lipase" refers to any protein that can catalyze the removal of a fatty acid chain from a triacylglycerol. Triacylglycerol lipases include TGL3.

The term "vector" refers to the means by which a nucleic acid can be propagated and/or transferred between organisms, cells, or cellular components. Vectors include plasmids, linear DNA fragments, viruses, bacteriophage, proviruses, phagemids, transposons, and artificial chromosomes, and the like, that may or may not be able to replicate autonomously or integrate into a chromosome of a host cell.

Microbe Engineering

A. Overview

In certain embodiments of the invention, a microorganism is genetically modified to increase its triacylglycerol content or modify its lipid profile.

Genes and gene products may be introduced into microbial host cells. Suitable host cells for expression of the genes and nucleic acid molecules are microbial hosts that can be found broadly within the fungal or bacterial families. Examples of suitable host strains include but are not limited to fungal or yeast species, such as *Arxula, Aspergillus, Aurantiochytrium, Candida, Claviceps, Cryptococcus, Cunninghamella, Geotrichum, Hansenula, Kluyveromyces, Kodamaea, Leucosporidiella, Lipomyces, Mortierella, Ogataea, Pichia, Prototheca, Rhizopus, Rhodosporidium, Rhodotorula, Saccharomyces, Schizosaccharomyces, Tremella, Trichosporon, Wickerhamomyces*, and *Yarrowia*, or bacterial species, such as members of proteobacteria and actinomycetes, as well as the genera *Acinetobacter, Arthrobacter, Brevibacterium, Acidovorax, Bacillus, Clostridia, Sreptomyces, Escherichia, Salmonella, Pseudomonas*, and *Cornyebacterium. Yarrowia lipolytica* and *Arxula adeninivorans* are well-suited for use as the host microorganism because they can accumulate a large percentage of their weight as triacylglycerols.

Microbial expression systems and expression vectors containing regulatory sequences that direct high level expression of foreign proteins are known to those skilled in the art. Any of these could be used to construct chimeric genes to produce any one of the gene products of the instant sequences. These chimeric genes could then be introduced into appropriate microorganisms via transformation techniques to provide high-level expression of the enzymes.

For example, a gene encoding an enzyme can be cloned in a suitable plasmid, and the aforementioned starting parent strain as a host can be transformed with the resulting plasmid. This approach can increase the copy number of each of the genes encoding the enzymes and, as a result, the activities of the enzymes can be increased. The plasmid is not particularly limited so long as it renders a desired gene inheritable to the microorganism's progeny.

Vectors or cassettes useful for the transformation of suitable host cells are well known in the art. Typically the vector or cassette contains sequences directing transcription and translation of the relevant genet, a selectable marker, and sequences allowing autonomous replication or chromosomal integration. Suitable vectors comprise a region 5' of the gene harboring transcriptional initiation controls and a region 3' of the DNA fragment which controls transcriptional termination. Both control regions may be derived from genes homologous to the transformed host cell, although it is to be understood that such control regions need not be derived from the genes native to the specific species chosen as a production host.

Promoters, cDNAs, and 3'UTRs, as well as other elements of the vectors, can be generated through cloning techniques using fragments isolated from native sources (Green & Sambrook, *Molecular Cloning: A Laboratory Manual*, (4th ed., 2012); U.S. Pat. No. 4,683,202; incorporated by reference). Alternatively, elements can be generated synthetically using known methods (Gene 164:49-53 (1995)).

B. Homologous Recombination

Homologous recombination is the ability of complementary DNA sequences to align and exchange regions of homology. Transgenic DNA ("donor") containing sequences homologous to the genomic sequences being targeted ("template") are introduced into the organism and then undergo recombination into the genome at the site of the corresponding genomic homologous sequences.

The ability to carry out homologous recombination in a host organism has many practical implications for what can be carried out at the molecular genetic level and is useful in the generation of a microbe that can produce a desired product. By its very nature homologous recombination is a precise gene targeting event, hence, most transgenic lines generated with the same targeting sequence will be essentially identical in terms of phenotype, necessitating the screening of far fewer transformation events. Homologous recombination also targets gene insertion events into the host chromosome, potentially resulting in excellent genetic stability, even in the absence of genetic selection. Because different chromosomal loci will likely impact gene expression, even from heterologous promoters/UTRs, homologous recombination can be a method of querying loci in an unfamiliar genome environment and to assess the impact of these environments on gene expression.

A particularly useful genetic engineering approach using homologous recombination is to co-opt specific host regulatory elements such as promoters/UTRs to drive heterologous gene expression in a highly specific fashion.

Because homologous recombination is a precise gene targeting event, it can be used to precisely modify any nucleotide(s) within a gene or region of interest, so long as sufficient flanking regions have been identified. Therefore, homologous recombination can be used as a means to modify regulatory sequences impacting gene expression of RNA and/or proteins. It can also be used to modify protein coding regions in an effort to modify enzyme activities such as substrate specificity, affinities and Km, and thus affecting the desired change in metabolism of the host cell. Homologous recombination provides a powerful means to manipulate the host genome resulting in gene targeting, gene conversion, gene deletion, gene duplication, gene inversion and exchanging gene expression regulatory elements such as promoters, enhancers and 3'UTRs.

Homologous recombination can be achieved by using targeting constructs containing pieces of endogenous sequences to "target" the gene or region of interest within the endogenous host cell genome. Such targeting sequences can either be located 5' of the gene or region of interest, 3' of the gene/region of interest or even flank the gene/region of interest. Such targeting constructs can be transformed into the host cell either as a supercoiled plasmid DNA with additional vector backbone, a PCR product with no vector backbone, or as a linearized molecule. In some cases, it may be advantageous to first expose the homologous sequences within the transgenic DNA (donor DNA) by cutting the transgenic DNA with a restriction enzyme. This step can increase the recombination efficiency and decrease the occurrence of undesired events. Other methods of increasing recombination efficiency include using PCR to generate transforming transgenic DNA containing linear ends homologous to the genomic sequences being targeted.

C. Vectors and Vector Components

Vectors for transformation of microorganisms in accordance with the present invention can be prepared by known techniques familiar to those skilled in the art in view of the disclosure herein. A vector typically contains one or more genes, in which each gene codes for the expression of a desired product (the gene product) and is operably linked to one or more control sequences that regulate gene expression or target the gene product to a particular location in the recombinant cell.

1. Control Sequences

Control sequences are nucleic acids that regulate the expression of a coding sequence or direct a gene product to a particular location inside or outside a cell. Control sequences that regulate expression include, for example, promoters that regulate transcription of a coding sequence and terminators that terminate transcription of a coding sequence. Another control sequence is a 3' untranslated sequence located at the end of a coding sequence that encodes a polyadenylation signal. Control sequences that direct gene products to particular locations include those that encode signal peptides, which direct the protein to which they are attached to a particular location inside or outside the cell.

Thus, an exemplary vector design for expression of a gene in a microbe contains a coding sequence for a desired gene product (for example, a selectable marker, or an enzyme) in operable linkage with a promoter active in yeast. Alternatively, if the vector does not contain a promoter in operable linkage with the coding sequence of interest, the coding sequence can be transformed into the cells such that it becomes operably linked to an endogenous promoter at the point of vector integration.

The promoter used to express a gene can be the promoter naturally linked to that gene or a different promoter.

A promoter can generally be characterized as constitutive or inducible. Constitutive promoters are generally active or function to drive expression at all times (or at certain times in the cell life cycle) at the same level. Inducible promoters, conversely, are active (or rendered inactive) or are significantly up- or down-regulated only in response to a stimulus. Both types of promoters find application in the methods of the invention. Inducible promoters useful in the invention include those that mediate transcription of an operably linked gene in response to a stimulus, such as an exogenously provided small molecule, temperature (heat or cold), lack of nitrogen in culture media, etc. Suitable promoters can activate transcription of an essentially silent gene or upregulate, preferably substantially, transcription of an operably linked gene that is transcribed at a low level.

Inclusion of termination region control sequence is optional, and if employed, then the choice is primarily one of convenience, as the termination region is relatively interchangeable. The termination region may be native to the transcriptional initiation region (the promoter), may be native to the DNA sequence of interest, or may be obtainable from another source (See, e.g., Chen & Orozco, Nucleic Acids Research 16:8411 (1988)).

2. Genes and Codon Optimization

Typically, a gene includes a promoter, coding sequence, and termination control sequences. When assembled by recombinant DNA technology, a gene may be termed an expression cassette and may be flanked by restriction sites for convenient insertion into a vector that is used to introduce the recombinant gene into a host cell. The expression cassette can be flanked by DNA sequences from the genome or other nucleic acid target to facilitate stable integration of the expression cassette into the genome by homologous recombination. Alternatively, the vector and its expression cassette may remain unintegrated (e.g., an episome), in which case, the vector typically includes an origin of replication, which is capable of providing for replication of the vector DNA.

A common gene present on a vector is a gene that codes for a protein, the expression of which allows the recombinant cell containing the protein to be differentiated from cells that do not express the protein. Such a gene, and its corresponding gene product, is called a selectable marker or selection marker. Any of a wide variety of selectable markers can be employed in a transgene construct useful for transforming the organisms of the invention.

For optimal expression of a recombinant protein, it is beneficial to employ coding sequences that produce mRNA with codons optimally used by the host cell to be transformed. Thus, proper expression of transgenes can require that the codon usage of the transgene matches the specific codon bias of the organism in which the transgene is being expressed. The precise mechanisms underlying this effect are many, but include the proper balancing of available aminoacylated tRNA pools with proteins being synthesized in the cell, coupled with more efficient translation of the transgenic messenger RNA (mRNA) when this need is met. When codon usage in the transgene is not optimized, available tRNA pools are not sufficient to allow for efficient translation of the transgenic mRNA resulting in ribosomal stalling and termination and possible instability of the transgenic mRNA.

D. Transformation

Cells can be transformed by any suitable technique including, e.g., biolistics, electroporation, glass bead transformation, and silicon carbide whisker transformation. Any convenient technique for introducing a transgene into a microorganism can be employed in the present invention. Transformation can be achieved by, for example, the method of D. M. Morrison (Methods in Enzymology 68:326 (1979)), the method by increasing permeability of recipient cells for DNA with calcium chloride (Mandel & Higa, J. Molecular Biology, 53:159 (1970)), or the like.

Examples of expression of transgenes in oleaginous yeast (e.g., *Yarrowia lipolytica*) can be found in the literature (Bordes et al., J. Microbiological Methods, 70:493 (2007); Chen et al., Applied Microbiology & Biotechnology 48:232 (1997)). Examples of expression of exogenous genes in bacteria, such as *E. coli*, are well known (Green & Sambrook, *Molecular Cloning: A Laboratory Manual*. (4th ed., 2012)).

Vectors for transformation of microorganisms in accordance with the present invention can be prepared by known techniques familiar to those skilled in the art. In one embodiment, an exemplary vector design for expression of a gene in a microorganism contains a gene encoding an enzyme in operable linkage with a promoter active in the microorganism. Alternatively, if the vector does not contain a promoter in operable linkage with the gene of interest, the gene can be transformed into the cells such that it becomes operably linked to a native promoter at the point of vector integration. The vector can also contain a second gene that encodes a protein. Optionally, one or both gene(s) is/are followed by a 3' untranslated sequence containing a polyadenylation signal. Expression cassettes encoding the two genes can be physically linked in the vector or on separate vectors. Co-transformation of microbes can also be used, in which distinct vector molecules are simultaneously used to transform cells (Protist 155:381-93 (2004)). The transformed cells can be optionally selected based upon the ability to grow in the presence of the antibiotic or other selectable marker under conditions in which cells lacking the resistance cassette would not grow.

Exemplary Nucleic Acids, Cell, and Methods

A. Diacylglycerol Acyltransferase Nucleic Acid Molecules and Vectors

Diacylglycerol acyltransferase is used as a model for increasing the activity of a protein, and the compositions and methods described below are generally applicable to other proteins in various organisms.

The diacylglycerol acyltransferase may be a type 1 diacylglycerol acyltransferase, type 2 diacylglycerol acyltransferase, or any other protein that catalyzes the conversion of diacylglycerol into a triacylglycerol. In some embodiments, the diacylglycerol acyltransferase is DGA1. For example, the diacylglycerol acyltransferase may be a DGA1 protein encoded by a DGAT2 gene selected from the group consisting of *Yarrowia lipolytica, Arxula adeninivorans, Rhodosporidium toruloides, Lipomyces starkeyi, Aspergillus terreus, Claviceps purpurea*, and *Aurantiochytrium limacinum*.

The DGAT2 gene may have a nucleotide sequence set forth in SEQ ID NOs: 16, 118, 120, 122, 124, 126, 128, 130, 132, or 134. In other embodiments, the DGAT2 gene is substantially identical to SEQ ID NOs: 16, 118, 120, 122, 124, 126, 128, 130, 132, or 134, and the nucleotide sequence encodes a protein that retains the functional activity of a protein encoded by SEQ ID NOs: 16, 118, 120, 122, 124, 126, 128, 130, 132, or 134, yet differs in nucleotide sequence due to natural allelic variation or mutagenesis. In another embodiment, the DGAT2 gene comprises an nucleotide sequence at least about 70%, 72%, 64%, 76%, 78%, 80%, 82%, 84%, 85%, 87%, 88%, 90%, 92%, 95%, 96%, 97%, 98%, 99%, 99.1%, 99.2%, 99.3%, 99.4%, 99.5%, 99.6%, 99.7%, 99.8%, 99.9% or more identical to SEQ ID NOs: 16, 118, 120, 122, 124, 126, 128, 130, 132, or 134.

The DGA1 protein may have an amino acid sequence set forth in SEQ ID NOs: 15, 117, 119, 121, 123, 125, 127, 129, 131 or 133. In other embodiments, the DGA1 protein is substantially identical to SEQ ID NOs: 15, 117, 119, 121, 123, 125, 127, 129, 131 or 133, and retains the functional activity of the protein of SEQ ID NOs: 15, 117, 119, 121, 123, 125, 127, 129, 131 or 133, yet differs in amino acid sequence due to natural allelic variation or mutagenesis. In another embodiment, the DGA1 protein comprises an amino acid sequence at least about 80%, 82%, 84%, 85%, 87%, 88%, 90% 92%, 95%, 96% 97%, 98%, 99%, 99.1%, 99.2%, 99.3%, 99.4%, 99.5%, 99.6%, 99.7%, 99.8%, 99.9% or more identical to SEQ ID NO: SEQ ID NOs: 15, 117, 119, 121, 123, 125, 127, 129, 131 or 133.

In some embodiments, the diacylglycerol acyltransferase is DGA2. For example, the diacylglycerol acyltransferase may be a DGA2 protein encoded by a DGAT1 gene found in an organism selected from the group consisting of *Yarrowia lipolytica, Rhodosporidium toruloides, Lipomyces starkeyi, Aspergillus terreus, Arxula adeninivorans, Claviceps purpurea*, and *Chaetomium globosum*.

The DGAT1 gene may have a nucleotide sequence set forth in SEQ ID NO: 18, 136, 138, 140, 142, 144, or 146. In other embodiments, the DGAT1 gene is substantially identical to SEQ ID NO: 18, 136, 138, 140, 142, 144, or 146, and the nucleotide sequence encodes a protein that retains the functional activity of a protein encoded by SEQ ID NO: 18, 136, 138, 140, 142, 144, or 146, yet differs in nucleotide sequence due to natural allelic variation or mutagenesis. In another embodiment, the DGAT1 gene comprises an nucleotide sequence at least about 70%, 72%, 64%, 76%, 78%, 80%, 82%, 84%, 85%, 87%, 88%, 90%, 92%, 95%, 9, 96%, 97%, 98%, 99%, 99.1%, 99.2%, 99.3%, 99.4%, 99.5%, 99.6%, 99.7%, 99.8%, 99.9% or more identical to SEQ ID NO: 18, 136, 138, 140, 142, 144, or 146.

The DGA2 protein may have an amino acid sequence set forth in SEQ ID NO: 17, 135, 137, 139, 141, 143, or 145. In other embodiments, the DGA2 protein is substantially identical to SEQ ID NO: 17, 135, 137, 139, 141, 143, or 145, and retains the functional activity of the protein of SEQ ID NO: 17, 135, 137, 139, 141, 143, or 145, yet differs in amino acid sequence due to natural allelic variation or mutagenesis. In another embodiment, the DGA2 protein comprises an amino acid sequence at least about 80%, 82%, 84%, 85%, 87%, 88%, 90%, 92%, 95%, 96%, 97%, 98%, 99%, 99.1%, 99.2%, 99.3%, 99.4%, 99.5%, 99.6%, 99.7%, 99.8%, 99.9% or more identical to SEQ ID NO: 17, 135, 137, 139, 141, 143, or 145.

The DGAT2 and DGAT1 genes may comprise conservative substitutions, deletions, and/or insertions while still encoding a protein that has functional diacylglycerol acyltransferase activity. For example, the DGAT2 and DGAT1 codons may be optimized for a particular host cell, different codons may be substituted for convenience, such as to introduce a restriction site or create optimal PCR primers, or codons may be substituted for another purpose. Similarly, the nucleotide sequence may be altered to create conservative amino acid substitutions, deletions, and/or insertions.

The DGA1 and DGA2 polypeptides may comprise conservative substitutions, deletions, and/or insertions while still maintaining functional diacylglycerol acyltransferase activity. Conservative substitution tables are well known in the art (Creighton, Proteins (2d. ed., 1992)).

Amino acid substitutions, deletions and/or insertions may readily be made using peptide synthetic techniques well known in the art, such as solid phase peptide synthesis and/or any other synthetic techniques, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), Quick Change Site Directed mutagenesis (Stratagene, San Diego, Calif.), PCR-mediated site-directed mutagenesis or other site-directed mutagenesis protocols.

To determine the percent identity of two amino acid sequences or of two nucleic acid sequences, the sequences can be aligned for optimal comparison purposes (e.g., gaps can be introduced in one or both of a first and a second amino acid or nucleic acid sequence for optimal alignment and non-identical sequences can be disregarded for comparison purposes). The length of a reference sequence aligned for comparison purposes can be at least 95% of the length of the reference sequence. The amino acid residues or nucleotides at corresponding amino acid positions or nucleotide positions can then be compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. In one embodiment, the percent identity between two amino acid sequences can be determined using the Needleman and Wunsch (J. Molecular Biology 48:444-453 (1970)) algorithm which has been incorporated into the GAP program in the GCG software package (available at http://www.gcg.com), using either a Blosum 62 matrix or a PAM250 matrix, and a gap weight of 16, 14, 12, 10, 8, 6, or 4 and a length weight of 1, 2, 3, 4, 5, or 6. In yet another embodiment, the percent identity between two nucleotide sequences can be determined using the GAP program in the GCG software package (available at http://www.gcg.com), using a NWSgapdna.CMP matrix and a gap weight of 40, 50, 60, 70, or 80 and a length weight of 1, 2, 3, 4, 5, or 6. In another embodiment, the percent identity between two amino acid or nucleotide sequences can be determined using the algorithm of E. Meyers and W. Miller (Computer Applications in the Biosciences 4:11-17 (1988)) which has been incorporated into the ALIGN program (version 2.0 or 2.0U), using a PAM120 weight residue table, a gap length penalty of 12 and a gap penalty of 4.

Exemplary computer programs which can be used to determine identity between two sequences include, but are not limited to, the suite of BLAST programs, e.g., BLASTN, MEGABLAST, BLASTX, TBLASTN, TBLASTX, and BLASTP, and Clustal programs, e.g., ClustalW, ClustalX, and Clustal Omega.

Sequence searches are typically carried out using the BLASTN program, when evaluating a given nucleic acid sequence relative to nucleic acid sequences in the GenBank DNA Sequences and other public databases. The BLASTX program is effective for searching nucleic acid sequences that have been translated in all reading frames against amino acid sequences in the GenBank Protein Sequences and other public databases.

An alignment of selected sequences in order to determine "% identity" between two or more sequences as performed using for example, the CLUSTAL-W program.

A "coding sequence" or "coding region" refers to a nucleic acid molecule having sequence information necessary to produce a protein product, such as an amino acid or polypeptide, when the sequence is expressed. The coding sequence may comprise and/or consist of untranslated sequences (including introns or 5' or 3' untranslated regions) within translated regions, or may lack such intervening untranslated sequences (e.g., as in cDNA).

The abbreviation used throughout the specification to refer to nucleic acids comprising and/or consisting of nucleotide sequences are the conventional one-letter abbreviations. Thus when included in a nucleic acid, the naturally occurring encoding nucleotides are abbreviated as follows: adenine (A), guanine (G), cytosine (C), thymine (T) and uracil (U). Also, unless otherwise specified, the nucleic acid sequences presented herein is the 5'→3'direction.

As used herein, the term "complementary" and derivatives thereof are used in reference to pairing of nucleic acids by the well-known rules that A pairs with T or U and C pairs with G. Complement can be "partial" or "complete". In partial complement, only some of the nucleic acid bases are matched according to the base pairing rules; while in complete or total complement, all the bases are matched according to the pairing rule. The degree of complement between the nucleic acid strands may have significant effects on the efficiency and strength of hybridization between nucleic acid strands as well known in the art. The efficiency and strength of said hybridization depends upon the detection method.

As used herein, "DGA1" means a diacylglycerol acyltransferase type 2 (DGAT2). DGA1 is an integral membrane protein that catalyzes the final enzymatic step in oil biosynthesis and the production of triacylglycerols in plants, fungi, and mammals. The DGA1 may play a key role in altering the quantity of long-chain polyunsaturated fatty acids produced in oils of oleaginous organisms. DGA1 is related to the acyl-coenzyme A:cholesterol acyltransferase ("ACAT"). This enzyme is responsible for transferring an acyl group from acyl-coenzyme-A to the sn-3 position of 1,2-diacylglycerol ("DAG") to form triacylglycerol ("TAG") (thereby involved in the terminal step of TAG biosynthesis). DGA1 is associated with membrane and lipid body fractions in plants and fungi, particularly, in oilseeds where it contributes to the storage of carbon used as energy reserves. TAG is believed to be an important chemical for storage of energy in cells. DGA1 is known to regulate TAG structure and direct TAG synthesis.

The DGA1 polynucleotide and polypeptide sequences may be derived from highly oleaginous organisms having very high, native levels of lipid accumulation. (Bioresource Technology 144:360-69 (2013); Progress Lipid Research 52:395-408 (2013); Applied Microbiology & Biotechnology 90:1219-27 (2011); European Journal Lipid Science & Technology 113:1031-51 (2011); Food Technology & Biotechnology 47:215-20 (2009); Advances Applied Microbiology 51:1-51 (2002); Lipids 11:837-44 (1976)). The list of organisms with reported lipid content about 50% and above are shown in Table 1. *R. toruloides* and *L. starkeyi* have the highest lipid content. Among the organisms in Table 1, only five had publicly accessible sequence for DGA1, *R. toruloides*, *L. starkeyi*, *A. limacinum*, *A. terreus*, and (*C. purpurea* (bolded in Table 1).

TABLE 1

List of oleaginous fungi with reported lipid content about 50% and above. Organisms with publicly accessible sequence for DGA1 gene are in bold. Fungi with reported high lipid content

Figure 3:
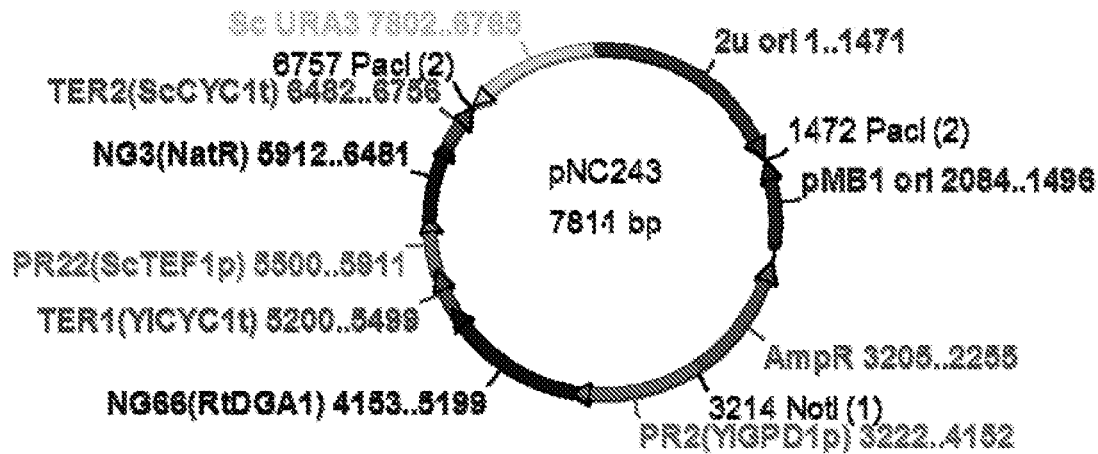
FIG. 3 depicts a map of the pNC243 construct used to overexpress the diacylglycerol acyltransferase DGA1 gene NG66. Vector pNC243 is linearized by a PacI/NotI restriction digest before transformation. "2u ori" denotes the *S. cerevisiae* origin of replication from the 2 µm circle plasmid; "pMB1 ori" denotes the *E. coli* pMB1 origin of replication from the pBR322 plasmid "AmpR" denotes the bla gene used as a marker for selection with ampicillin; "PR2" denotes the *Y. lipolytica* GPD1 promoter −931 to −1; "NG66" denotes the native *Rhodosporidium toruloides* DGA1 cDNA synthesized by GenScript; "TER1" denotes the *Y. lipolytica* CYC1 terminator 300 base pairs after stop; "PR22" denotes the *S. cerevisiae* TEF1 promoter −412 to −1; "NG3" denotes the *Streptomyces noursei* Nat1 gene used as a marker for selection with nourseothricin; "TER2" denotes the *S. cerevisiae* CYC1 terminator 275 base pairs after stop; and "Sc URA3" denotes the *S. cerevisiae* URA3 auxotrophic marker for selection in yeast.

Aspergillus terreus
Aurantiochytrium limacinum
Claviceps purpurea
Cryptococcus albidus
Cryptococcus curvatus
Cryptococcus ramirezgomezianus
Cryptococcus terreus
Cryptococcus wieringae
Cunninghamella echinulata
Cunninghamella japonica
Leucosporidiella creatinivora
Lipomyces lipofer
Lipomyces starkeyi
Lipomyces tetrasporus
Mortierella isabellina
Prototheca zopfii
Rhizopus arrhizus
Rhodosporidium babjevae
Rhodosporidium paludigenum
Rhodosporidium toruloides
Rhodotorula glutinis
Rhodotorula mucilaginosa
Tremella enchepala
Trichosporon cutoneum
Trichosporon fermentans Nucleic acid constructs for increasing the activity of DGA1 were described in U.S. Ser. No. 61/943,664 and PCT patent application Ser. No. 15/017,227 (both hereby incorporated by reference). FIG. 3 shows expression construct pNC243 used for overexpression of the *R. toruloides* DGA1 gene NG66 (SEQ ID NO: 6) in *Y. lipolytica*. DGA1 expression constructs were linearized before transformation by PacI/NotI restriction digest. The linear expression constructs each included the expression cassette for DGA1 gene and for the Nat1 gene, used as marker for selection with nourseothricin (NAT).

Nucleic acid constructs for increasing the activity of DGA2 and/or other diacylglycerol acyltransferases may be created using the methods described above and/or other methods known in the art. Similarly, nucleic acid constructs that increase the activity of other proteins may be engineered as described for DGA1 above and/or by other methods known in the art.

B. Triacylglycerol Lipase Nucleic Acid Molecules and Vectors

Triacylglycerol lipase is used as a model for decreasing the activity of a protein, and the compositions and methods described below are generally applicable to other proteins in various organisms.

Triacylglycerol lipase depletes a cell's triacylglycerol by removing one or more fatty acid chains. Thus, decreasing the net triacylglycerol lipase activity of a cell may increase the cell's triacylglycerol. This decrease may be accomplished by reducing the efficiency of the enzyme, e.g., by mutating amino acids in its active site, or by reducing the expression of the enzyme. For example, a TGL3 knockout mutation will decrease the activity of a triacylglycerol lipase because it prevents the cell from transcribing TGL3.

In some embodiments, the triacylglycerol lipase is TGL3.

The TGL3 gene in *Y. lipolytica* encodes the triacylglycerol lipase protein TGL3 (SEQ ID NO: 147). SEQ ID NO: 148 contains the TGL3 nucleotide sequence, 100 upstream nucleotides, and 100 downstream nucleotides. Thus, the SEQ ID NO: 148 nucleotide sequence may be used to design a nucleic acid capable of recombining with a nucleic acid sequence in the native *Y. lipolytica* triacylglycerol lipase gene.

Knockout cassettes SEQ ID NOS: 160 and 161 are capable of recombining with the native TGL3 gene in *Y. lipolytica*. Thus, in some embodiments, the nucleic acids encoded by SEQ ID NOS: 160 and 161 may be used to generate a triacylglycerol lipase knockout mutation in *Y. lipolytica*. SEQ ID NOS: 160 and 161 each contain portions of a hygromycin resistance gene hph. Neither isolated sequence encodes a functional protein, but the two sequences are capable of encoding a functional kinase that confers hygromycin resistance upon successful recombination. Further, neither SEQ ID NO: 160 nor SEQ ID NO: 161 contains a promoter or terminator, and thus, they rely on homologous recombination with the *Y. lipolytica* TGL3 gene in order for the hph gene to be transcribed and translated. In this way, successfully transformed oleaginous cells may be selected by growing the cells on medium containing hygromycin.

Knockout cassette SEQ ID NO: 160 may be prepared by amplifying a hygromycin resistance gene hph (SEQ ID NO: 152) with primer NP1798 (SEQ ID NO: 157) and primer NP656 (SEQ ID NO: 154). Knockout cassette SEQ ID NO: 161 may be prepared by amplifying a hygromycin resistance gene hph (SEQ ID NO: 152) with primer NP655 (SEQ ID NO: 153) and primer NP1799 (SEQ ID NO: 158).

Different approaches may be used to design nucleic acids that reduce the activity of the TGL3 gene in *Y. lipolytica* (Biochimica Biophysica Acta 1831:1486-95 (2013)). The methods disclosed herein and other methods known in the art may be used to reduce the activity of triacylglycerol lipase and other genes in various species, including *Arxula adeninivorans*.

C. Transformed Cell

In some embodiments, the transformed cell is a prokaryotic cell, such as a bacterial cell. In some embodiments, the cell is a eukaryotic cell, such as a yeast cell or a filamentous fungi cell.

The cell may be selected from the group consisting of *Arxula*, *Aspergillus*, *Aurantiochytrium*, *Candida*, *Claviceps*, *Cryptococcus*, *Cunninghamella*, *Geotrichum*, *Hansenula*, *Kluyveromyces*, *Kodamaea*, *Leucosporidiella*, *Lipomyces*, *Mortierella*, *Ogataea*, *Pichia*, *Prototheca*, *Rhizopus*, *Rhodosporidium*, *Rhodotorula*, *Saccharomyces*, *Schizosaccharomyces*, *Tremella*, *Trichosporon*, *Wickerhamomyces*, and *Yarrowia*.

In some embodiments, the cell is selected from the group consisting of *Arxula adeninivorans*, *Aspergillus niger*, *Aspergillus oryzae*, *Aspergillus terreus*, *Aurantiochytrium limacinum*, *Candida utilis*, *Claviceps purpurea*, *Cryptococcus albidus*, *Cryptococcus curvatus*, *Cryptococcus ramirezgomezianus*, *Cryptococcus terreus*, *Cryptococcus wieringae*, *Cunninghamella echinulata*, *Cunninghamella japonica*, *Geotrichum fermentans*, *Hansenula polymorpha*, *Kluyveromyces lactis*, *Kluyveromyces marxianus*, *Kodamaea ohmeri*, *Leucosporidiella creatinivora*, *Lipomyces lipofer*, *Lipomyces starkeyi*, *Lipomyces tetrasporus*, *Mortierella isabellina*, *Mortierella alpina*, *Ogataea poly-*

*morpha, Pichia ciferrii, Pichia guilliermondii, Pichia pastoris, Pichia stipites, Prototheca zopfii, Rhizopus arrhizus, Rhodosporidium babjevau, Rhodosporidium toruloides, Rhodosporidium paludigenum, Rhodotorula glutinis, Rhodotorula mucilaginosa, Saccharomyces cerevisiae, Schizosaccharomyces prombe, Tremella enchepala, Trichosporon cutaneum, Trichosporon fermentans, Wickerhamomyces ciferrii,* and *Yarrowia lipolytica.*

In certain embodiments, the transformed cell is a high-temperature tolerant yeast cell. In some embodiments the transformed cell is *Kluyveromyces marxianus.*

In certain embodiments, the cell is *Yarrowia lipolytica* or *Arxula adeninivorans.*

D. Increasing the Activity of a Protein in a Cell

A protein's activity may be increased by overexpressing the protein. Proteins may be overexpressed in a cell using a variety of genetic modifications. In some embodiments, the genetic modification increases the expression of a native protein. A native protein may be overexpressed by modifying the upstream transcription regulators of a native gene, for example, by increasing the expression of a transcription activator or decreasing the expression of a transcription repressor. Alternatively, the promoter of a native gene may be substituted with a constitutively active or inducible promoter by recombination with an exogenous nucleic acid.

In some embodiments, the genetic modification encodes at least one copy of a gene. The gene may be a gene native to the cell or from a different species. In certain embodiments, the gene is inheritable to the progeny of a transformed cell. In some embodiments, the gene is inheritable because it resides on a plasmid. In certain embodiments, the gene is inheritable because it is integrated into the genome of the transformed cell.

In certain embodiments, the gene is a type 2 diacylglycerol acyltransferase gene ("DGAT2") from *Aspergillus terreus, Arxula adeninivorans, Aurantiochytrium limacinum, Claviceps purpurea, Lipomyces starkeyi, Rhodosporidium toruloides,* or *Yarrowia lipolytica.* In certain embodiments, diacylglycerol acyltransferase is overexpressed by transforming a cell with a gene encoding a diacylglycerol acyltransferase gene. The genetic modification may encode one or more than one copy of a diacylglycerol acyltransferase gene. In certain embodiments, the genetic modification encodes at least one copy of the DGA1 protein from *R. toruloides.* In some embodiments, the genetic modification encodes at least one copy of the DGA1 protein from *R. toruloides* and the transformed cell is *Y. lipolytica.* In some embodiments, the genetic modification encodes at least one copy of the DGA1 protein from *R. toruloides,* and the transformed cell is *Arxula adeninivorans.*

In certain embodiments, the gene is a type 1 diacylglycerol acyltransferase gene ("DGAT1") from *Aspergillus terreus, Arxula adeninivorans, Chaetomium globosum, Claviceps purpurea, Lipomyces starkeyi, Rhodosporidium toruloides,* or *Yarrowia lipolytica.* In certain embodiments, diacylglycerol acyltransferase is overexpressed by transforming a cell with a gene encoding a diacylglycerol acyltransferase gene. The genetic modification may encode one or more than one copy of a diacylglycerol acyltransferase gene. In certain embodiments, the genetic modification encodes at least one copy of the DGA2 protein from *Claviceps purpurea.* In some embodiments, the genetic modification encodes at least one copy of the DGA2 protein from *C. purpurea* and the transformed cell is *Y. lipolytica.* In some embodiments, the genetic modification encodes at least one copy of the DGA2 protein from *C. purpurea,* and the transformed cell is *Arxula adeninivorans.*

In some embodiments, the DGA1 protein is from *R. toruloides* and the DGA2 protein is from *C. purpurea.* In some embodiments, the DGA1 protein is from *R. toruloides,* the DGA2 protein is from *C. purpurea,* and the transformed cell is *Y. lipolytica.* In some embodiments, the DGA1 protein is from *R. toruloides,* the DGA2 protein is from *C. purpurea,* and the transformed cell is *Arxula adeninivorans.*

E. Decreasing the Activity of a Protein in a Cell

A protein's activity may be decreased using a variety of different genetic modifications. In some embodiments, the transformed cell comprises a genetic modification that decreases the activity of a native protein. Such genetic modifications may affect a protein that regulates the transcription of a gene, including modifications that decrease the expression of a transcription activator and/or increase the expression of a transcription repressor. Modifications that affect a regulator protein may both decrease the expression of target protein and alter other gene expression profiles that shift the cellular equilibrium toward increased lipid accumulation or modified lipid composition. Alternatively, the genetic modification may be the introduction of a small interfering RNA, or a nucleic acid that encodes a small interfering RNA. In other embodiments, the genetic modification consists of the homologous recombination of a nucleic acid and the regulatory region of a gene, including an operator, promoter, sequences upstream from the promoter, enhancers, and sequences downstream of the gene.

In some embodiments the transformed oleaginous cell comprises a genetic modification consisting of a homologous recombination event. In certain embodiments, the transformed cell comprises a genetic modification consisting of a homologous recombination event between a gene and a nucleic acid. Thus, the genetic modification deletes the gene, prevents its transcription, or prevents the transcription of a gene that can be transcribed into a fully-active protein. A homologous recombination event may mutate or delete a portion of a gene. For example, the homologous recombination event may mutate one or more residues in the active site of an enzyme, thereby reducing the efficiency of the enzyme or rendering it inactive. Alternatively, the homologous recombination event may affect post-translational modification, folding, stability, or localization within the cell. In some embodiments, the homologous recombination event replaces the promoter with a promoter that drives less transcription. In other embodiments, the homologous recombination event mutates the promoter to impair its ability to drive transcription. In certain embodiments, the genetic modification is a knockout mutation.

A knockout mutation may delete a gene. Additionally, the knockout mutation may substitute the native gene with an exogenous gene that encodes a different protein. The exogenous gene may be operably linked to an exogenous promoter. In certain embodiments, the exogenous gene is not linked to an exogenous promoter, and instead, the exogenous gene is configured to recombine with the native gene such that the native gene's promoter drives transcription of the exogenous gene. Thus, the exogenous gene is less likely to be expressed if it randomly integrates into the cell's genome. Methods for creating knockouts are well-known in the art (See. g., Fickers et al., J. Microbiological Methods 55:727 (2003)).

In certain embodiments, the genetic modification comprises two homologous recombination events. In the first event, a nucleic acid encoding a portion of an exogenous gene recombines with the native gene, and in the second event, a nucleic acid encoding the remaining portion of the exogenous gene recombines with the native gene. The two portions of the exogenous gene are designed such that neither portion is functional unless they recombine with each other. These two events further reduce the likelihood that the exogenous gene can be expressed following random integration events.

In certain embodiments, the exogenous gene encodes a dominant selectable marker. Thus, knockout cells may be selected by screening for the marker. In some embodiments, the dominant selectable marker is a drug resistance marker. A drug resistance marker is a dominant selectable marker that, when expressed by a cell, allows the cell to grow and/or survive in the presence of a drug that would normally inhibit cellular growth and/or survival. Cells expressing a drug resistance marker can be selected by growing the cells in the presence of the drug. In some embodiments, the drug resistance marker is an antibiotic resistance marker. In some embodiments, the drug resistance marker confers resistance to a drug selected from the group consisting of Amphotericin B, Candicidin, Filipin, Hamycin, Natamycin, Nystatin, Rimocidin, Bifonazole, Butoconazole, Clotrimazole, Econazole, Fenticonazole, Isoconazole, Ketoconazole, Luliconazole, Miconazole, Omoconazole, Oxiconazole, Sertaconazole, Sulconazole, Tioconazole, Albaconazole, Fluconazole, Isavuconazole, Itraconazole, Posaconazole, Ravuconazole, Terconazole, Voriconazole, Abafungin, Amorolfin, Butenafine, Naftifine, Terbinafine, Anidulafungin, Caspofungin, Micafungin, Benzoic acid, Ciclopirox, Flucytosine, 5-fluorocytosine, Griseofulvin, Haloprogin, Polygodial, Tolnaftate, Crystal violet, Amikacin, Gentamicin, Kanamycin, Neomycin, Netilmicin, Tobramycin, Paromomycin, Spectinomycin, Geldanamycin, Herbimycin, Rifaximin, Streptomycin, Loracarbef, Ertapenem, Doripenem, Imipenem, Meropenem, Cefadroxil, Cefazolin, Cefalotin, Cefalexin, Cefaclor, Cefamandole, Cefoxitin, Cefprozil, Cefuroxime, Cefixime, Cefdinir, Cefditoren, Cefoperazone, Cefotaxime, Cefpodoxime, Ceftazidime, Ceftibuten, Ceftizoxime, Ceftriaxone, Cefepime, Ceftaroline fosamil, Ceftobiprole, Teicoplanin, Vancomycin, Telavancin, Clindamycin, Lincomycin, Daptomycin, Azithromycin, Clarithromycin, Dirithromycin, Erythromycin, Roxithromycin, Troleandomycin, Telithromycin, Spiramycin, Aztreonam, Furazolidone, Nitrofurantoin, Linezolid, Posizolid, Radezolid, Torezolid, Amoxicillin, Ampicillin, Azlocillin, Carbenicillin, Cloxacillin, Dicloxacillin, Flueloxacillin, Mezlocillin, Methicillin, Nafcillin, Oxacillin, Penicillin G, Penicillin V, Piperacillin, Penicillin G, Temocillin, Ticarcillin, clavulanate, sulbactam, tazobactam, clavulanate, Bacitracin, Colistin, Polymyxin B, Ciprofloxacin, Enoxacin, Gatifloxacin, Levofloxacin, Lomefloxacin, Moxifloxacin, Nalidixic acid, Norfloxacin, Ofloxacin, Trovafloxacin, Grepafloxacin, Sparfloxacin, Temafloxacin, Mafenide, Sulfacetamide, Sulfadiazine, Silver sulfadiazine, Sulfadimethoxine, Sulfamethizole, Sulfamethoxazole, Sulfanilimide, Sulfasalazine, Sulfisoxazole, Trimethoprim-Sulfamethoxazole, Co-trimoxazole, Sulfonamidochrysoidine, Demeclocycline, Doxycycline, Minocycline, Oxytetracycline, Tetracycline, Clofazimine, Dapsone, Capreomycin, Cycloserine, Ethambutol, Ethionamide, Isoniazid, Pyrazinamide, Rifaunpicin, Rifabutin, Rifapentine, Streptomycin, Arsphenamine, Chloramphenicol. Fosfomycin, Fusidic acid, Metronidazole, Mupirocin, Platensimycin, Quinupristin, Dalfopristin, Thiamphenicol, Tigecycline, Tinidazole, Trimethoprim, Geneticin, Nourscothricin, Hygromycin, Bleomycin, and Puromycin.

In some embodiments, the dominant selectable marker is a nutritional marker. A nutritional marker is a dominant selectable marker that, when expressed by the cell, enables the cell to grow or survive using one or more particular nutrient sources. Cells expressing a nutritional marker can be selected by growing the cells under limiting nutrient conditions in which cells expressing the nutritional marker can survive and/or grow, but cells lacking the nutrient marker cannot. In some embodiments, the nutritional marker is selected from the group consisting of Orotidine 5-phosphate decarboxylase, Phosphite specific oxidoreductase. Alpha-ketoglutarate-dependent hypophosphite dioxygenase, Alkaline phosphatase, Cyanamide hydratase, Melamine deaminase, Cyanurate amidohydrolase, Biuret hydrolyase, Urea amidolyase, Ammelide aminohydrolase, Guanine deaminase, Phosphodiesterase, Phosphotriesterase, Phosphite hydrogenase, Glycerophosphodiesterase, Parathion hydrolyase, Phosphite dehydrogenase. Dibenzothiophene desulfurization enzyme, Aromatic desulfinase, NADH-dependent FMN reductase, Aminopurine transporter, Hydroxylamine oxidoreductase, Invertase, Beta-glucosidase, Alpha-glucosidase, Beta-galactosidase, Alpha-galactosidase, Amylase, Cellulase, and Pullulonase.

In some embodiments, a genetic modification decreases the expression of a native gene by 0.1, 0.2, 0.3, 0.4, 0.5, 0.6, 0.7, 0.8, 0.9, 1, 2, 3, 4, 5, 6, 7, 8, 9, 10, 25, 30, 35, 40, 45, 50, 55, 60, 65, 70, 75, 80, 85, 90, 91, 92, 93, 94, 95, 96, 97, 98, 99, 99.1, 99.2, 99.3, 99.4, 99.5, 99.6, 99.7, 99.8, 99.9, or 100 percent.

In some embodiments, a genetic modification decreases the efficiency of a native gene by 0.1, 0.2, 0.3, 0.4, 0.5, 0.6, 0.7, 0.8, 0.9, 1, 2, 3, 4, 5, 6, 7, 8, 9, 10, 25, 30, 35, 40, 45, 50, 55, 60, 65, 70, 75, 80, 85, 90, 91, 92, 93, 94, 95, 96, 97, 98, 99, 99.1, 99.2, 99.3, 99.4, 99.5, 99.6, 99.7, 99.8, 99.9, or 100 percent.

In some embodiments, a genetic modification decreases the activity of a native gene by 0.1, 0.2, 0.3, 0.4, 0.5, 0.6, 0.7, 0.8, 0.9, 1, 2, 3, 4, 5, 6, 7, 8, 9, 10, 25, 30, 35, 40, 45, 50, 55, 60, 65, 70, 75, 80, 85, 90, 91, 92, 93, 94, 95, 96, 97, 98, 99, 99.1, 99.2, 99.3, 99.4, 99.5, 99.6, 99.7, 99.8, 99.9, or 100 percent.

F. Decreasing Acyl-CoA Oxidase Activity in a Cell with Concomitant Overexpression of Diacylglycerol Acyltransferase In some embodiments, the transformed oleaginous cell comprises a acyl-CoA oxidase knockout mutation and a genetic modification that increase the expression of a native diacylglycerol acyltransferase. In certain embodiments, the transformed oleaginous cell comprises a acyl-CoA oxidase knockout mutation and a genetic modification that encodes at least one copy of a diacylglycerol acyltransferase gene that is either native to the cell or from a different species of cell. In some embodiments, a POX gene is disrupted and a DGA1 protein is overexpressed. In other embodiments, a POX gene is disrupted and a DGA2 protein is overexpressed.

In some embodiments, one nucleic acid increases the expression of a native diacylglycerol acyltransferase or encodes at least one copy of a diacylglycerol acyltransferase gene and a second nucleic acid decreases the activity of a acyl-CoA oxidase in the cell. In some embodiments the same nucleic acid encodes at least one copy of a diacylglycerol acyltransferase gene and decreases the activity of a acyl-CoA oxidase in the cell. For example, the nucleic acid designed to knock out a acyl-CoA oxidase gene may also contain a copy of a diacylglycerol acyltransferase gene.

G. Decreasing Both Triacylglycerol Lipase and Acyl-CoA Oxidase Activity in a Cell In some embodiments, the transformed oleaginous cell comprises a acyl-CoA oxidase knockout mutation and a triacylglycerol lipase knockout mutation. In certain embodiments, a TGL3, TGL3/4, and/or TGL4 gene is disrupted. In certain embodiments, a POX gene is disrupted. In some embodiments, a first nucleic acid decreases the activity of a triacylglycerol acyltransferase in the cell and a second nucleic acid decreases the activity of a acyl-CoA oxidase in the cell.

H. Triacylglycerol Production

In certain embodiments, the transformed cells are grown in the presence of exogenous fatty acids, glucose, ethanol, xylose, sucrose, starch, starch dextrin, glycerol, cellulose, and/or acetic acid. These substrates may be added during cultivation to increase lipid production. The exogenous fatty acids may include stearate, oleic acid, linoleic acid, γ-linolenic acid, dihomo-γ-linolenic acid, arachidonic acid, α-linolenic acid, stearidonic acid, eicosatetraenoic acid, eicosapentaenoic acid, docosapentaenoic acid, eicosadienoic acid, and/or eicosatrienoic acid.

In certain embodiments, the present invention relates to a product produced by a modified host cell described herein. In certain embodiments, the product is an oil, lipid, or triacylglycerol. In some embodiments, the product is palmitic acid, palmitoleic acid, stearic acid, oleic acid, or linoleic acid. In certain embodiments, the product as a saturated fatty acid. Thus, the product may be caprylic acid, capric acid, lauric acid, myristic acid, palmitic acid, stearic acid, arachidic acid, behenic acid, lignoceric acid, or cerotic acid. In some embodiments, the product is an unsaturated fatty acid. Thus, the product may be myristoleic acid, palmitoleic acid, sapienic acid, oleic acid, elaidic acid, vaccenic acid, linoleic acid, linoelaidic acid, α-linolenic acid, arachidonic acid, eicosapentaenoic acid, erucic acid, or docosahexaenoic acid.

The product may be selected from the group consisting of lipids, triacylglycerides, fatty alcohols, fatty acids, alkanes, alkenes, isoprenoids, isoprene, squalene, farnasene, alcohols, isopropanol, n-propanol, n-butanol, isobutanol, 2-butanol, butadiene, diols, 1,3 propanediol, 1,4 propanediol, succinic acid, adipic acid, nylon precursors, citric acid, malic acid, polyols, and erythritol.

I. Increasing the Activity of a Protein to Increase or Modify the Lipid Content of a Cell In some embodiments, the invention relates to a nucleic acid comprising a nucleotide sequence set firth in SEQ ID NO: 12, 22, 86, 94, 100, 104, 110, 173, or 177. In some embodiments, the invention relates to a nucleic acid comprising a nucleotide sequence having at least 70%, 72%, 64%, 76%, 78%, 80%, 82%, 84%, 85%, 87%, 88%, 90%, 92%, 95%, 96%, 97%, 98%, 99%, 99.1%, 99.2%, 99.3%, 99.4%, 99.5%, 99.6%, 99.7%, 99.8%, or 99.9% sequence homology with a nucleotide sequence set forth in SEQ ID NO: 12, 22, 86, 94, 100, 104, 110, 173, or 177. In some embodiments, the invention relates to a nucleic acid that encodes an amino acid sequence having at least 80%, 82%, 84%, 85%, 87%, 88%, 90%, 92%, 95%, 96%, 97%, 98%, 99%, 99.1%, 99.2%, 99.3%, 99.4%, 99.5%, 99.6%, 99.7%, 99.8%, or 99.9% sequence homology with an amino acid sequence set forth in SEQ ID NO: 11, 21, 85, 93, 99, 103, 109, 172, or 176. In some embodiments, the nucleic acid further comprises a promoter. In certain embodiments, the nucleotide sequence and promoter are operably linked. In some embodiments, the promoter is not an *Arxula adeninivorans* promoter.

In some embodiments, the invention relates to a plasmid vector comprising a gene encoding a protein selected from Acetyl-CoA carboxylase ("ACC," Gene NG160, SEQ ID:2), ATP-citrate lyase, subunit 1 ("ACL1," Gene NG161, SEQ ID: 4), ATP-citrate lyase, subunit 2 ("ACL2," Gene NG162, SEQ ID NO:6), Acetyl-coA synthetase isoform 1 ("ACS1," Gene NG163, SEQ ID NO:8), Acetyl-coA synthetase isoform 2, ("ACS2," Genes NG164, NG165. SEQ ID NOs:10, 12), Diacylglycerol acyltransferase type 2 ("DGA1," Gene NG167, SEQ ID NO: 16), Diacylglycerol acyltransferase type 1 ("DGA2." Gene NG168, SEQ ID NO: 18), Glycecrol-3-phosphate dehydrogenase ("GPD1," Genes NG169, NG170, SEQ ID NOs:20, 22), Malic enzyme ("MAE1," Gene NG171, SEQ ID NO:24), 1-acyl-sn-glycerol-3-phosphate acyltransferase ("SLC1," Gene NG177, SEQ ID NO:36), Phospholipid:diacylglycerol acyltransferase ("LRO1," Gene NG178, SEQ ID NO:38), Glycerol kinase ("GUT1," Gene NG182, SEQ ID NO:46), Glycerol-3-phosphate acyl transferase ("SCT1" Gene NG183, SEQ ID NO:48), Phosphatidate phosphatase ("PAH1," Gene NG218, SEQ ID NO:50), Fatty acid synthase, subunit alpha ("FAS2," Gene NG186, SEQ ID NO:54), Fatty acid synthase, subunit beta ("FAS1," Gene NG187, SEQ ID NO:56), Type 2A-related protein phosphatase ("SIT4," Gene NG188, SEQ ID NO:58), Regulatory subunit of type 1 protein phosphatase Glc7p ("REG1," Gene NG189, SEQ ID NO:60), Regulatory subunit of Sit4 phosphatase ("SAP190," Gene NG190. SEQ ID NO:62). Dephospho-CoA kinase ("DPCK," Gene NG191, SEQ ID NO:64), HAC1 basic leucine zipper transcription factor ("HAC1," Gene NG192, SEQ ID NO:66), CAT8 zinc finger transcription factor ("CAT8," Gene NG193, SEQ ID NO:68), Ubiquitin ("UBI4." Gene NG194, SEQ ID NO:70), STB5 transcription factor ("STB5," Gene NG199, SEQ ID NO:80), Pyruvate carboxylase ("PYC1," Genes NG201, NG202 SEQ ID NOs:84, 86), Pyruvate decarboxylase ("PDC1," Gene NG203, SEQ ID NO:88), Malate dehydrogenase 1 ("MDH1," Gene NG204, SEQ ID NO:90), Malate dehydrogenase 2 ("MDH2," Genes NG205, NG206 SEQ ID NOs: 92, 94), Pyruvate dehydrogenase alpha ("PDA1," Gene NG207, SEQ ID NO:96), Pyruvate dehydrogenase beta ("PDB1," Genes NG208, NG209 SEQ ID NOs:98, 100), Glucose-6-phosphate dehydrogenase ("ZWF1," Genes NG210, NG211 SEQ ID NOs:102, 104), 6-phosphogluconate dehydrogenase ("GND1," Gene NG212, SEQ ID NO:106), Citrate synthase 1 ("CIT1," Genes NG213, NG214, SEQ ID NOs: 108, 110), Citrate synthase 2 ("CIT2," Genes NG215, NG216 SEQ ID NOs: 112, 114), Aldehyde dehydrogenase ("ALD6." Gene NG217, SEQ ID NO: 116), Olyecrol-3-phosphate/dihydroxyacetone phosphate sn-1 acyltransferase ("GPT2," Gene NG219, SEQ ID NO:167), Lysophospholipid acyltransferase ("SLC4," Gene NG220, SEQ ID NO:169), and Lysophosphatidic acid acyltransferase ("LOA1," Genes NG221, NG222 SEQ ID NOs: 171, 173).

In some embodiments, the invention relates to a vector comprising a nucleotide sequence having at least 70%, 72%, 64%, 76%, 78%, 80%, 82%, 84%, 85%, 87%, 88%, 90%, 92%, 95%, 96%, 97%, 98%, 99%, 99.1%, 99.2%, 99.3%, 99.4%, 99.5%, 99.6%, 99.7%, 99.8%, or 99.9% sequence homology with a nucleotide sequence set forth in SEQ ID NO: 2, 4, 6, 8, 10, 12, 16, 18, 20, 22, 24, 36, 38, 46, 48, 50, 54, 56, 58, 60, 62, 64, 66, 68, 70, 80, 84, 86, 88, 90, 92, 94, 96, 98, 100, 102, 104, 106, 108, 110, 112, 114, 116, 167, 169, 171, or 173. In some embodiments, the invention relates to a vector that encodes an amino acid sequence having at least 80%, 82%, 84%, 85%, 87%, 88%, 90%, 92%, 95%, 96%, 97%, 98%, 99%, 99.1%, 99.2%, 99.3%, 99.4%, 99.5%, 99.6%, 99.7%, 99.8%, or 99.9% sequence homology with an amino acid sequence set forth in SEQ ID NO: 1, 3, 5, 7, 9, 11, 15, 17, 19, 21, 23, 35, 37, 45, 47, 49, 53, 55, 57, 59, 61, 63, 65, 67, 69, 79, 83, 85, 87, 89, 91, 93, 95, 97, 99, 101, 103, 105, 107, 109, 111, 113, 115, 166, 168, 170, or 172. In some embodiments, the vector is a plasmid. In some embodiments, vector further comprises a promoter. In certain embodiments, the nucleotide sequence and promoter are operably linked. In some embodiments, the promoter is not an *Arxula adeninivorans* promoter.

In some embodiments, the invention relates to a transformed cell comprising a genetic modification that increases the activity of a protein selected from an Acetyl-CoA carboxylase; ATP-citrate lyase, subunit 1; ATP-citrate lyase, subunit 2; Acetyl-coA synthetase isoform 1; Acetyl-CoA carboxylase; ATP-citrate lyase, subunit 1; ATP-citrate lyase, subunit 2; Acetyl-coA synthetase isoform 1; Acetyl-coA synthetase isoform 2; Diacylglycerol acyltransferase type 2; Diacylglycerol acyltransferase type 1: Glycerol-3-phosphate dehydrogenase; Malic enzyme; 1-acyl-sn-glycerol-3-phosphate acyltransferase; Phospholipid:diacylglycerol acyltransferase; Glycerol kinase; Glycerol-3-phosphate acyl transferase; Phosphatidate phosphatase; Fatty acid synthase, subunit alpha; Fatty acid synthase, subunit beta; Type 2A-related protein phosphatase; Regulatory subunit of type 1 protein phosphatase Glc7p; Regulatory subunit of Sit4 phosphatase; Dephospho-CoA kinase; HAC1 basic leucine zipper transcription factor; CAT8 zinc finger transcription factor; Ubiquitin; STB5 transcription factor; Pyruvate carboxylase; Pyruvate decarboxylase; Malate dehydrogenase; Pyruvate dehydrogenase; Glucose-6-phosphate dehydrogenase; 6-phosphogluconate dehydrogenase; Citrate synthase; Aldehyde dehydrogenase; Phosphatidate phosphates; Glycerol-3-phosphate/dihydroxyacetone phosphate sn-1 acyltransferase; Lysophospholipid; and Lysophosphatidic acid acyltransferase.

In some embodiments, the invention relates to a transformed cell comprising a genetic modification, wherein the genetic modification is transformation with a nucleic acid comprising a nucleotide sequence that encodes Acetyl-CoA carboxylase ("ACC," Gene NG160, SEQ ID:2), ATP-citrate lyase, subunit 1 ("ACL1," Gene NG161, SEQ ID: 4). ATP-citrate lyase, subunit 2 ("ACL2." Gene NG162, SEQ ID NO:6), Acetyl-coA synthetase isoform 1 ("ACS1," Gene NG163, SEQ ID NO:8), Acetyl-coA synthetase isoform 2, ("ACS2," Genes NG164, NG165. SEQ ID NOs:10,12), Diacylglycerol acyltransferase type 2 ("DGA1," Gene NG167, SEQ ID NO: 16), Diacylglycerol acyltransferase type 1 ("DGA2," Gene NG168, SEQ ID NO:18), Glycerol-3-phosphate dehydrogenase ("GPD1," Genes NG169, NG170, SEQ ID NOs:20, 22), Malic enzyme ("MAE1," Gene NG171, SEQ ID NO:24). L-acyl-sn-glycerol-3-phosphate acyltransferase ("SLC1," Gene NG177, SEQ ID NO:36), Phospholipid:diacylglycerol acyltransferase ("LRO1," Gene NG178, SEQ ID NO:38). Glycerol kinase ("GUT1," Gene NG182, SEQ ID NO:46), Glycerol-3-phosphate acyl transferase ("SCT1," Gene NG183, SEQ ID NO:48), Phosphatidate phosphatase ("PAH1'," Gene NG218. SEQ ID NO:50). Fatty acid synthase, subunit alpha ("FAS2," Gene NG186, SEQ ID NO:54), Fatty acid synthase, subunit beta ("FAS1," Gene NG187, SEQ ID NO:56), Type 2A-related protein phosphatase ("SIT4," Gene NG188, SEQ ID NO:58), Regulatory subunit of type 1 protein phosphatase Glc7p ("REG1," Gene NG189. SEQ ID NO:60), Regulatory subunit of Sit4 phosphatase ("SAP190," Gene NG190, SEQ ID NO:62), Dephospho-CoA kinase ("DPCK," Gene NG191. SEQ ID NO:64), HAC1 basic leucine zipper transcription factor ("HAC1," Gene NG192, SEQ ID NO:66), CAT5 zinc finger transcription factor ("CAT5," Gene NG193. SEQ ID NO:68). Ubiquitin ("UBI4," Gene NG194, SEQ ID NO:70), STB5 transcription factor ("STB5," Gene NG199, SEQ ID NO:80), Pyruvate carboxylase ("PYC1," Genes NG201, NG202 SEQ ID NOs:84, 86), Pyruvate decarboxylase ("PDC1." Gene NG203, SEQ ID NO:88), Malate dehydrogenase 1 ("MDH1," Gene NG204, SEQ ID NO:90), Malate dehydrogenase 2 ("MDH2," Genes NG205, NG206 SEQ ID NOs: 92, 94), Pyruvate dehydrogenase alpha ("PDA1," Gene NG207, SEQ ID NO:96), Pyruvate dehydrogenase beta ("PDB1," Genes NG208, NG209 SEQ ID NOs:98, 100), Glucose-6-phosphate dehydrogenase ("ZWF1," Genes NG210, NG211 SEQ ID NOs: 102, 104), 6-phosphogluconate dehydrogenase ("GND1" Gene NG212, SEQ ID NO:106), Citrate synthase 1 ("CIT1," Genes NG213, NG214, SEQ ID NOs: 108, 110). Citrate synthase 2 ("CIT2," Genes NG215, NG216 SEQ ID NOs: 112, 114). Aldehyde dehydrogenase ("ALD6," Gene NG217, SEQ ID NO: 116), Glycerol-3-phosphate/dihydroxyacetone phosphate sn-1 acyltransferase ("GPT2," Gene NG219, SEQ ID NO:167), Lysophospholipid acyltransferase ("SLC4," Gene NG220, SEQ ID NO:169), or Lysophosphatidic acid acyltransferase ("LOA1," Genes NG221, NG222 SEQ ID NOs: 171, 173).

In some embodiments, the invention relates to a transformed cell comprising a genetic modification, wherein the genetic modification is transformation with a nucleic acid comprising a nucleotide sequence having at least 70%, 72%, 64%, 76%, 78%, 80%, 82%, 84%, 85%, 87%, 88%, 90%, 92%, 95%, 96%, 97%, 98%, 9%9%, 99.1%, 99.2%, 99.3%, 99.4%, 99.5%, 99.6%, 99.7%, 99.8%, or 99.9% sequence homology with a nucleotide sequence set forth in SEQ ID NO: 2, 4, 6, 8, 10, 12, 16, 18, 20, 22, 24, 36, 38, 46, 48, 50, 54, 56, 58, 60, 62, 64, 66, 68, 70, 80, 84, 86, 88, 90, 92, 94, 96, 98, 100, 102, 104, 106, 108, 110, 112, 114, 116, 167, 169, 171, or 173. In some embodiments, the invention relates to a transformed cell comprising a genetic modification, wherein the genetic modification is transformation with a nucleic acid that encodes an amino acid sequence having at least 80% 82%, 8, 84%, 85% 87%, 88%, 90%, 92%, 95%, 96% 97%, 98%, 99% 99.1%, 99.2%, 99.3%, 99.4%, 99.5%, 99.6%, 99.7%, 99.8%, or 99.9% sequence homology with an amino acid sequence set forth in SEQ ID NO: 1, 3, 5, 7, 9, 11, 15, 17, 19, 21, 23, 35, 37, 45, 47, 49, 53, 55, 57, 59, 61, 63, 65, 67, 69, 79, 83, 85, 87, 89, 91, 93, 95, 97, 99, 101, 103, 105, 107, 109, 111, 113, 115, 166, 168, 170, or 172.

In some embodiments, the invention relates to a method of modifying the lipid content and/or composition of a cell, comprising transforming a parent cell with a nucleic acid comprising a nucleotide sequence having at least 70%, 72%, 64%, 76%, 78%, 80%, 82%, 84%, 85%, 87%, 88%, 90%, 92%, 95% 6, 96%, 97%, 98%, 99%, 99.1%, 99.2%, 99.3%, 99.4%, 99.5%, 99.6%, 99.7%, 99.8%, or 99.9% sequence homology with a nucleotide sequence set forth in SEQ ID NO: 2, 4, 6, 8, 10, 12, 16, 18, 20, 22, 24, 36, 38, 46, 48, 50, 54, 56, 58, 60, 62, 64, 66, 68, 70, 80, 84, 86, 88, 90, 92, 94, 96, 98, 100, 102, 104, 106, 108, 110, 112, 114, 116, 167, 169, 171, or 173. In some embodiments, the invention relates to a method of modifying the lipid content and/or composition of a cell, comprising transforming a parent cell with a nucleic acid encoding an amino acid sequence having at least 80%, 82%, 84%, 85%, 87%, 88%, 90%, 92%, 95%, 96%, 97%, 98%, 99%, 99.1%, 99.2%, 99.3%, 99.4%, 99.5%, 99.6%, 9999.7%, 99.8%, or 99.9% sequence homology with an amino acid sequence set forth in SEQ ID NO: 1, 3, 5, 7, 9, 11, 15, 17, 19, 21, 23, 35, 37, 45, 47, 49, 53, 55, 57, 59, 61, 63, 65, 67, 69, 79, 83, 85, 87, 89, 91, 93, 95, 97, 99, 101, 103, 105, 107, 109, 111, 113, 115, 166, 168, 170, or 172.

J. Decreasing the Activity of a Protein to Increase or Modify the Lipid Content of a Cell In some embodiments, the invention relates to a transformed *Arxula adeninivorans* cell comprising a genetic modification that decreases the activity of a protein selected from Multi-functional enzyme involved in B-oxidation ("MFE1," Gene NG172, SEQ ID NO:26), Triacylglycerol lipase ("TGL3," Gene NG174, SEQ ID NO:30), triacylglycerol lipase ("TGL3/4," Gene NG175, SEQ ID NO:32), Triacylglycerol lipase ("TGL4," Gene NG176. SEQ ID NO:34), Glycerol-3-phosphate dehydrogenase ("GUT2," Gene NG179, SEQ ID NO:40), AMP-activated kinase ("SNF1," Gene NG180, SEQ ID NO:42), Acyl-CoA oxidase ("POX," Gene NG181, SEQ ID NO:44), Peroxisomal membrane E3 ubiquitin ligase ("PEX10," Gene NG196, SEQ ID NO:74), Dihydrolipoamide acetyltransferase component (E2) of pyruvate dehydrogenase complex ("LAT1," Gene NG197, SEQ ID NO:76). Transcription factor involved in glucose repression ("MIG1," Gene NG198, SEQ ID NO:78), 2-methylcitrate dehydratase ("PHD1" Gene NG200, SEQ ID NO:82), Phosphatidyl-ethanolamine methyltransferase ("CHO2." Gene NG226, SEQ ID NO: 165), Methylene-fatty-acyl-phospholipid synthase ("OPI3," Gene NG223, SEQ ID NO:175), and INO4 transcription factor ("INO4," Gene NG225, SEQ ID NO: 179). In some embodiments, the genetic modification is a knockout mutation.

K. Increasing or Decreasing the Activity of a Protein to Modify Lipid Content and/or Composition In some embodiments, the invention relates to a plasmid vector comprising a gene encoding a protein selected from Delta-12 fatty acid desaturase ("D12," Gene NG166, SEQ ID NO:14), Delta-9 fatty acid desaturase ("OLE1," Gene NG173, SEQ ID NO:28), Fatty acid elongase 2 ("ELO2," Gene NG185, SEQ ID NO:52), and Fatty acid elongase 1 ("ELO1," Gene NG195, SEQ ID NO:72).

In some embodiments, the invention relates to a vector comprising a nucleotide sequence having at least 70%, 72%, 64%, 76%, 78%, 80%, 82%, 84%, 85%, 87%, 88%, 90%, 92%, 95%, 96%, 97%, 98%, 99%, 99.1%, 99.2%, 99.3%, 99.4%, 99.5%, 99.6%, 99.7%, 99.8%, or 99.9% sequence homology with a nucleotide sequence set forth in SEQ ID NO: 14, 28, 52, or 72. In some embodiments, the invention relates to a vector that encodes an amino acid sequence having at least 80%, 82%, 84%, 85%, 87%, 88%, 90%, 92%, 95%, 96%, 97%, 98%, 99%, 99.1%, 99.2%, 99.3%, 99.4%, 99.5%, 99.6%, 99.7%, 99.8%, or 99.9% sequence homology with an amino acid sequence set forth in SEQ ID NO: 13, 27, 51, or 71. In some embodiments, the vector is a plasmid.

In some embodiments, the invention relates to a transformed cell comprising a genetic modification that increases the activity of a protein selected from a Delta-12 fatty acid desaturase, Delta-9 fatty acid desaturase, and Fatty acid elongase.

In some embodiments, the invention relates to a transformed cell comprising a genetic modification, wherein the genetic modification is transformation with a nucleic acid comprising a nucleotide sequence that encodes Delta-12 fatty acid desaturase ("D12," Gene NG166, SEQ ID NO:14), Delta-9 fatty acid desaturase ("OLE1," Gene NG173. SEQ ID NO:28), Fatty acid elongase 2 ("ELO2," Gene NG185, SEQ ID NO:52), or Fatty acid elongase 1 ("ELO1," Gene NG195, SEQ ID NO:72).

In some embodiments, the invention relates to a transformed cell comprising a genetic modification, wherein the genetic modification is transformation with a nucleic acid comprising a nucleotide sequence having at least 70%, 72%, 64%, 76%, 78%, 80%, 82%, 84%, 85%, 87%, 88%, 90%, 92%, 95%, 96%, 97%, 98%, 99%, 99.1%, 99.2%, 99.3%, 99.4%, 99.5%, 99.5%, 99.6%, 99.7%, 99.8%, or 99.9% sequence homology with a nucleotide sequence set forth in SEQ ID NO: 14, 28, 52, or 72. In some embodiments, the invention relates to a transformed cell comprising a genetic modification, wherein the genetic modification is transformation with a nucleic acid encoding an amino acid sequence having at least 80%, 82%, 84%, 85%, 87%, 88%, 90%, 92%, 95%, 96%, 97%, 98%, 99%, 99.1%, 99.2%, 99.3%, 99.4%, 99.5%, 99.6%, 99.7%, 99.8%, or 99.9% sequence homology with an amino acid sequence set forth in SEQ ID NO: 13, 27, 51, or 71.

In some embodiments, the invention relates to a method of modifying the lipid content and/or composition of a cell, comprising transforming a parent cell with a nucleic acid comprising a nucleotide sequence having at least 70%, 72%, 64%, 76%, 78%, 80%, 82%, 84%, 85%, 87%, 88%, 90%, 92%, 95%, 96%, 97%, 98%, 99%, 99.1%, 99.2%, 99.3%, 99.4%, 99.5%, 99.6%, 99.7%, 99.8%, or 99.9% sequence homology with a nucleotide sequence set forth in SEQ ID NO: 14, 28, 52, or 72. In some embodiments, the invention relates to a method of modifying the lipid content and/or composition of a cell, comprising transforming a parent cell with a nucleic acid encoding an amino acid sequence having at least 80%, 82%, 84%, 85%, 87%, 88%, 90%, 92%, 95%, 96%, 97%, 98%, 99%, 99.1%, 99.2%, 99.3%, 99.4%, 99.5%, 99.6% 99.99. %, 99.8%, or 99.9% sequence homology with an amino acid sequence set forth in SEQ ID NO: 13, 27, 51, or 71.

In some embodiments, the invention relates to a transformed *Arxula adeninivorans* cell comprising a genetic modification that decreases the activity of a protein selected from Delta-12 fatty acid desaturase ("D12," Gene NG166, SEQ ID NO:14), Delta-9 fatty acid desaturase ("OLE1" Gene NO 173, SEQ ID NO:28), Fatty acid elongase 2 ("ELO2," Gene NG185, SEQ ID NO:52), and Fatty acid elongase 1 ("ELO1" Gene NG195, SEQ ID NO:72). In some embodiments, the genetic modification is a knockout mutation.

The present description is further illustrated by the following examples, which should not be construed as limiting in any way. The contents of all cited references (including literature references, issued patents, published patent applications and GenBank Accession numbers as cited throughout this application) are hereby expressly incorporated by reference. When definitions of terms in documents that are incorporated by reference herein conflict with those used herein, the definitions used herein govern.

EXEMPLIFICATION

Example 1: Sequencing the *Arxula adeninivorans* Genome and Selecting Genetic Targets In order to engineer an *A. adeninivorans* strain with optimal lipid content and composition, native *A. adeninivorans* genes (genetic targets) were screened for a positive or negative effect on lipid production in *A. adeninivorans*.

First, in order to access DNA and protein sequences of selected targets, the genome of *A. adeninivorans* strain NS252 (ATCC 76597) was sequenced and annotated by Synthetic Genomics Inc. (CA, USA). Strain NS252 was also selected as a host for screening the genetic targets.

Genetic targets that affect lipid production efficiency and composition were enumerated based on published data assessing lipid pathways in oleaginous yeast and other organisms (Ratledge & Wynn, Advances Applied Microbiology 51:1-51 (2002); Tai & Stephanopoulos, Metabolic Engineering 15:1-9 (2013), Beopoulos et al., Applied & Environmental Microbiology, 74:7779-89 (2008); Beopoulos et al., Progress Lipid Research, 48:375-87 (2009); Courchesne et al., J. Biotechnology 141:31-41 (2009); Morin et al., PLoS One, 6(11):e27966 (2011); Bozaquel-Morais et al., PLoS One, 5(10):e13692 (2010)). The sequences of the genetic targets selected for screening in *A. adeninivorans* are shown in SEQ ID NO: 1-116 and 164-179, and listed in Table 2 below.

TABLE 2

*Arxula adeninivorans* genes that may be upregulated or downregulated in *Arxula adeninivorans* and other organisms to increase the organism's lipid content, modify its lipid composition, or both.

| Gene | ID | Function | DNA SEQ ID NO | Modification |
|---|---|---|---|---|
| ACC | NG160 | Acetyl-CoA carboxylase | 2 | Increase activity to increase lipid content |
| ACL1 | NG161 | ATP-citrate lyase, subunit 1 | 4 | Increase activity to increase lipid content |
| ACL2 | NG162 | ATP-citrate lyase, subunit 2 | 6 | Increase activity to increase lipid content |
| ACS1 | NG163 | Acetyl-coA synthetase isoform 1 | 8 | Increase activity to increase lipid content |
| ACS2 | NG164, NG165* | Acetyl-coA synthetase isoform 2 | 10, 12* | Increase activity to increase lipid content |
| D12 | NG166 | Delta-12 fatty acid desaturase | 14 | Increase or decrease activity to modify lipid composition |
| DGA1 | NG167 | Diacylglycerol acyltransferase type 2 | 16 | Increase activity to increase lipid content |
| DGA2 | NG168 | Diacylglycerol acyltransferase type 1 | 18 | Increase activity to increase lipid content |
| GPD1 | NG169, NG170* | Glycerol-3-phosphate dehydrogenase | 20, 22* | Increase activity to increase lipid content |
| MAE1 | NG171 | Malic enzyme | 24 | Increase activity to increase lipid content |
| MFE1 | NG172 | Multi-functional enzyme involved in B-oxidation | 26 | Decrease activity to increase lipid content |
| OLE1 | NG173 | Delta-9 fatty acid desaturase | 28 | Increase or decrease activity to modify lipid composition |
| TGL3 | NG174 | Triacylglycerol lipase | 30 | Decrease activity to increase lipid content |
| TGL3/4 | NG175 | Triacylglycerol lipase | 32 | Decrease activity to increase lipid content |
| TGL4 | NG176 | Triacylglycerol lipase | 34 | Decrease activity to increase lipid content |
| SLC1 | NG177 | 1-acyl-sn-glycerol-3-phosphate acyltransferase | 36 | Increase activity to increase lipid content |
| LRO1 | NG178 | Phospholipid: diacylglycerol acyltransferase | 38 | Increase activity to increase lipid content |
| GUT2 | NG179 | Glycerol-3-phosphate dehydrogenase | 40 | Decrease activity to increase lipid content |
| SNF1 | NG180 | AMP-activated kinase | 42 | Decrease activity to increase lipid content |
| POX | NG181 | Acyl-CoA oxidase | 44 | Decrease activity to increase lipid content |
| GUT1 | NG182 | Glycerol kinase | 46 | Increase activity to increase lipid content |
| SCT1 | NG183 | Glycerol-3-phosphate acyl transferase | 48 | Increase activity to increase lipid content |
| PAH1 | NG218 | Phosphatidate phosphatase | 50 | Increase activity to increase lipid content |
| ELO2 | NG185 | Fatty acid elongase | 52 | Increase or decrease activity to modify lipid composition |
| FAS2 | NG186 | Fatty acid synthase, subunit alpha | 54 | Increase activity to increase lipid content |
| FAS1 | NG187 | Fatty acid synthase, subunit beta | 56 | Increase activity to increase lipid content |
| SIT4 | NG188 | Type 2A-related protein phosphatase | 58 | Increase activity to increase lipid content |
| REG1 | NG189 | Regulatory subunit of type 1 protein phosphatase Glc7p | 60 | Increase activity to increase lipid content |
| SAP190 | NG190 | Regulatory subunit of Sit4 phosphatase | 62 | Increase activity to increase lipid content |

TABLE 2-continued

*Arxula adeninivorans* genes that may be upregulated or downregulated in *Arxula adeninivorans* and other organisms to increase the organism's lipid content, modify its lipid composition, or both.

| Gene | ID | Function | DNA SEQ ID NO | Modification |
|---|---|---|---|---|
| DPCK | NG191 | Dephospho-CoA kinase | 64 | Increase activity to increase lipid content |
| HAC1 | NG192 | Basic leucine zipper transcription factor | 66 | Increase activity to increase lipid content |
| CAT8 | NG193 | Zinc finger transcription factor | 68 | Increase activity to increase lipid content |
| UBI4 | NG194 | Ubiquitin | 70 | Increase activity to increase lipid content |
| ELO1 | NG195 | Fatty acid elongase | 72 | Increase or decrease activity to modify lipid composition |
| PEX10 | NG196 | Peroxisomal membrane E3 ubiquitin ligase | 74 | Decrease activity to increase lipid content |
| LAT1 | NG197 | Dihydrolipoamide acetyltransferase component (E2) of pyruvate dehydrogenase complex | 76 | Decrease activity to increase lipid content |
| MIG1 | NG198 | Transcription factor involved in glucose repression | 78 | Decrease activity to increase lipid content |
| STB5 | NG199 | Transcription factor | 80 | Increase activity to increase lipid content |
| PHD1 | NG200 | 2-methylcitrate dehydratase | 82 | Decrease activity to increase lipid content |
| PYC1 | NG201, NG202* | Pyruvate carboxylase | 84, 86* | Increase activity to increase lipid content |
| PDC1 | NG203 | Pyruvate decarboxylase | 88 | Increase activity to increase lipid content |
| MDH1 | NG204 | Malate dehydrogenase | 90 | Increase activity to increase lipid content |
| MDH2 | NG205, NG206* | Malate dehydrogenase | 92, 94* | Increase activity to increase lipid content |
| PDA1 | NG207 | Pyruvate dehydrogenase alpha | 96 | Increase activity to increase lipid content |
| PDB1 | NG208, NG209* | Pyruvate dehydrogenase beta | 98, 100* | Increase activity to increase lipid content |
| ZWF1 | NG210, NG211* | Glucose-6-phosphate dehydrogenase | 102, 104* | Increase activity to increase lipid content |
| GND1 | NG212 | 6-phosphogluconate dehydrogenase | 106 | Increase activity to increase lipid content |
| CIT1 | NG213, NG214* | Citrate synthase | 108, 110* | Increase activity to increase lipid content |
| CIT2 | NG215, NG216* | Citrate synthase | 112, 114* | Increase activity to increase lipid content |
| ALD6 | NG217 | Aldehyde dehydrogenase | 116 | Increase activity to increase lipid content |
| CHO2 | NG226 | Phosphatidyl-ethanolamine methyltransferase | 165 | Decrease activity to increase lipid content |
| GPT2 | NG219 | Glycerol-3-phosphate/ dihydroxyacetone phosphate sn-1 acyltransferase | 167 | Increase activity increase lipid content |
| SLC4 | NG220 | Lysophospholipid acyltransferase | 169 | Increase activity to increase lipid content |
| LOA1 | NG221, NG222* | Lysophosphatidic acid acyltransferase | 171, 173* | Increase activity to increase lipid content |
| OPI3 | NG223, NG224* | Methylene-fatty-acyl-phospholipid synthase | 175, 177* | Decrease activity to increase lipid content |
| INO4 | NG225 | Transcription factor involved in phospholipid synthesis | 179 | Decrease activity to increase lipid content |

*denotes nucleotide sequences without introns, corresponding to *Arxula adeninivorans* genes that contain introns.

The genetic targets were either up-regulated or down-regulated to increase lipid production and/or modify lipid composition depending on the target's role in the lipid pathway. For example, the targets involved in the final step of triacylglycerol synthesis, such as NG167 (DGA1) and NG168 (DGA2) were overexpressed, while targets involved in peroxisomal lipid degradation, such as NG73 (TGL3) and NG181 (POX), were down-regulated by deletion. The targets were applied individually or in combination.

For changing lipid composition, the same target can be either up-regulated or down-regulated depending on the desired composition. For example, the combination of NG173 (delta-9 fatty acid desaturase "OLE1") overexpression and NG166 (delta-12 fatty acid desaturase "D12") down-regulation or deletion could result in an increased oleic acid content in A. adeninivorans. Alternatively, overexpression of both NG173 and NG166 could result in an increase of linoleic acid content.

Example 2: Increasing the Activity of a Target Protein

Figure 1:
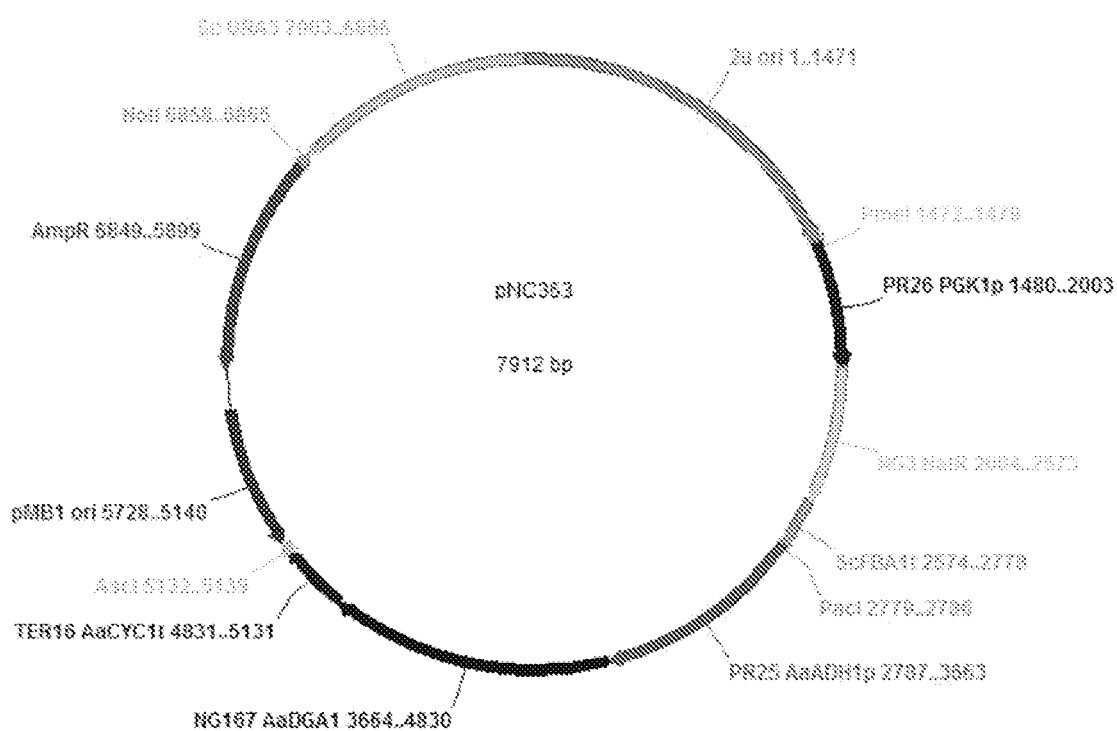
FIG. 1 depicts a map of the pNC363 construct used to overexpress the NG167 gene (AaDga1) in *A. adeninivorans* strain NS252 (ATCC 76597). Vector pNC363 was linearized by a PmeI/AscI restriction digest before transformation. "2u ori" denotes the *S. cerevisiae* origin of replication from the 2 µm circle plasmid; "pMB1 ori" denotes the *E. coli* pMB1 origin of replication from the pBR322 plasmid; "AmpR" denotes the bla gene used as a marker for selection with ampicillin; "Sc URA3" denotes the *S. cerevisiae* URA3 auxotrophic marker for selection in yeast; PR26 PGK1p denotes the *A. adeninivorans* PGK1 promoter −524 to −1; "NG3 NatR" denotes the *Streptomyces noursei* Nat1 gene used as a marker for selection with nourscothricin; "ScFBA1t" denotes the *S. cerevisiae* FBA1 terminator 205 bp after stop; "PR25 AaADH1p" denotes the *A. adeninivorans* ADH1 promoter −877 to −1; "NG167 AaDGA1" denotes the *A. adeninivorans* DGA1 gene ORF (NG167); "TER16 CYC1t" denotes the *A. adeninivorans* CYC1 terminator 301 bp after stop codon.

The map of the expression construct used to overexpress the up-regulation targets is shown in FIG. 1 with the NG167 target (type 2 diacylglycerol acyltransferase "DGA1") as an example. The constructs for all other up-regulated targets were the same except for the target ORFs. The overexpression constructs were assembled by the yeast mediated ligation method. The constructs were linearized by PmeI/AscI restriction digest before transformation into NS252 by the transformation procedure described by Chen (Applied Microbiology & Biotechnology 48:232-35 (1997)). The linear expression construct included an expression cassette for a genetic target and for the Streptomyces noursei Nat1 gene used as marker for selection with nourseothricin (NAT).

The up-regulated targets that contain introns were expressed in two forms: native genes amplified from the genomic DNA of NS252 strain and intron-free synthetic cDNA synthesized by GenScript (NJ, USA).

Example 3: Decreasing the Activity of a Target Protein

Figure 2:
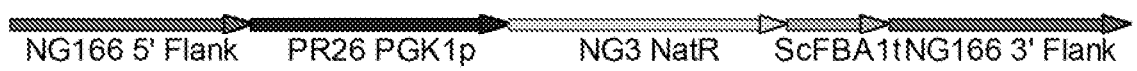
FIG. 2 depicts a map of the deletion cassette used to delete the NG166 gene in *A. adeninivorans* strain NS252 (ATCC 76597). "NG166 5' Flank" denotes the 500 base pairs upstream of the NG166 open reading frame used as a recombination flank for NG166 deletion; "PR26 PGK1p" denotes the *A. adeninivorans* PGK1 promoter −524 to −1; "NG3 NatR" denotes the *Streptomyces noursei* Nat1 gene used as marker for selection with nourscothricin; "ScFBA1t" denotes the *S. cerevisiae* FBA1 terminator 205 bp after stop; "NG166 3' Flank" denotes the 500 base pairs downstream of the NG166 open reading frame used as recombination flank for NG166 deletion.

The map of the deletion construct used to delete the down-regulation targets is shown on the FIG. 2 with the NG166 target (delta-12 fatty acid desaturase "D12") as an example. The deletion constructs for all other down-regulation targets were the same except for the target's recombination flanks that were specific to the targets. The deletion constructs were assembled by the yeast mediated ligation method, and they included an expression cassette for the Streptomyces noursei Nat gene used as marker for selection with NAT flanked by upstream and downstream DNA regions of the genetic targets. The recombination flanks were either amplified from the genomic DNA of NS252 strain or synthesized by Integrated DNA Technologies, Inc. (Iowa, USA) as part of the oligonucleotides used for the yeast mediated ligation plasmid assembly.

Example 4: Screening Strategies

Both overexpression and deletion transformants were selected on YPD plates with 50 µg/ml NAT. Additionally, the transformants were analyzed by a fluorescent lipid assay described below to screen for increased lipid content. To screen for an optimized lipid composition, the transformants were analyzed by gas chromatography using standard methods for the lipid composition analysis.

Example 5: Modifying Multiple Targets

After a first round of screening targets, the best transformants are transformed again with the overexpression or deletion construct that contains either the same target (for overexpression) or different targets for further increasing lipid production or optimizing lipid composition. In the second round of screening, a similar approach is used as in the first round, except for the selection marker. The Escherichia coli hph gene expression cassette can be used as a marker for selection with hygromycin B for the second round of screening. For combinations of more than two targets, additional dominant markers can be used, or alternatively, a marker recycling procedure can be used similar to the approaches used with other yeast species (Akada et al., Yeast, 23:399-05 (2006); Sauer, Biotechniques 16:1086-88 (1994); Hartzog et al., Yeast, 22:789-98 (2005)).

Example 6: Optimizing Large Activity

After the optimal combination of native A. adeninivorans genetic targets is determined, each target in the selected set can be further optimized. For example, in the case of gene deletion, when complete gene removal has a negative effect on an organisms' growth rate or another culturing parameter, a target can be integrated back into the NS252 genome under a weak or inducible promoter to express a minimal amount of the target protein. In such cases, decreasing the target's expression or timing its expression at particular bioprocess stages can be more beneficial for the overall product yield than complete removal of the target.

In the case of an overexpression target, each selected target can be further optimized by screening heterologous targets with the same function from different organisms for better expression or specific activity. The targets can also be optimized by protein engineering, by introducing mutations that improve protein expression or activity. Another optimization approach for the overexpression targets involves screening regulatory elements such as promoters that are more optimal for a particular target.

Example 7: Lipid Assay

Each well of an autoclaved, multi-well plate was filled with filter-sterilized media containing 0.5 g/L urea, 1.5 g/L yeast extract, 0.85 g/L casamino acids, 1.7 g/L YNB (without amino acids and ammonium sulfate), 100 g/L, glucose, and 5.11 g/L potassium hydrogen phthalate (25 mM). 1.5 mL of media was used per well for 24-well plates and 300 µl of media was used per well for 96-well plates. Alternatively, the yeast cultures were used to inoculate 50 mL of sterilized media in an autoclaved 250 mL flask. Yeast strains that had been incubated for 1-2 days on YPD-agar plates at 30° C. were used to inoculate each well of the multiwall plate.

Multi-well plates were covered with a porous cover and incubated at 30° C., 70-90% humidity, and 900 rpm in an Infors Multitron ATR shaker. Alternatively, flasks were covered with aluminum foil and incubated at 30° C., 70-90% humidity, and 900 rpm in a New Brunswick Scientific shaker. After 96 hours, 20 µL of 100% ethanol was added to 20 µL of cells in an analytical microplate and incubated at 4° C. for 30 minutes. 20 µL of cell/ethanol mix was then added to 80 µl of a pre-mixed solution containing 50 µL 1

M potassium iodide, 1 mM μL Bodipy 493/503, 0.5 μL 100% DMSO, 1.5 μL 60% PEG 4000), and 27 μL water in a Costar 96-well, black, clear-bottom plate and covered with a transparent seal. Bodipy fluorescence was monitored with a SpectraMax M2 spectrophotometer (Molecular Devices) kinetic assay at 30° C., and normalized by dividing fluorescence by absorbance at 600 nm.

Example 8: Method to Overexpress the DGA1 Protein (DGAT2 Gene) in Yeast

Nucleic acid constructs for overexpressing the DGA1 gene were described in U.S. Ser. No. 61/943,664 and PCT patent application Ser. No. 15/017,227 (both hereby incorporated by reference). FIG. 3 shows expression construct pNC243 used for overexpression of the R. toruloides DGA1 gene NG66 (SEQ ID NO: 122). DGA1 expression constructs were linearized before transformation by a PacI/NotI restriction digest. The linear expression constructs each included an expression cassette for the DGAT2 gene and for the Nat1 gene, used as a marker for selection with nourseothricin (NAT).

DGA1 expression constructs were randomly integrated into the genome of Y. lipolytica strain NS18 (obtained from ARS Culture Collection, NRRL # YB 392) using a transformation protocol as described in Chen (Applied Microbiology & Biotechnology 48:232-35 (1997)). Transformants were selected on YPD plates with 500 μg/mL NAT and screened for the ability to accumulate lipids by a fluorescent staining lipid assay as described in Example 7 above. For each expression construct, eight transformants were analyzed.

For most constructs, there was significant colony variation between the transformants, likely due to the lack of a functional DGA1 expression cassette in cells that only obtained a functional Nat1 cassette, or due to a negative effect of the site of DGA1 integration on DGA1 expression. Nevertheless, all transformants had a significant increase in lipid content.

Overexpression of native Y. lipolytica DGA1 (NG15) under a strong promoter increased the transformant lipid content by about 2-fold compared to the parental strain NS18 as measured by the fluorescence assay described in Example 7. Transformants that demonstrated the highest fluorescence (about 3-fold higher compared to NS18) were generated by the overexpression of R. toruloides DGA1 (NG66, NG67) and L. starkeyi DGA (NG68).

In certain experiments, the effect of native R. toruloides DGA1 (NG49) overexpression on lipid production was not as high as the effect of synthetic versions of R. toruloides DGAT2 genes that did not contain introns. This result may indicate that the gene splicing of the R. toruloides DGAT2 gene in Y. lipolytica was not very efficient. In certain experiments, codon optimization of the R. toruloides DGA1 gene for expression in Y. lipolytica did not have a positive effect on lipid production.

Figure 4:
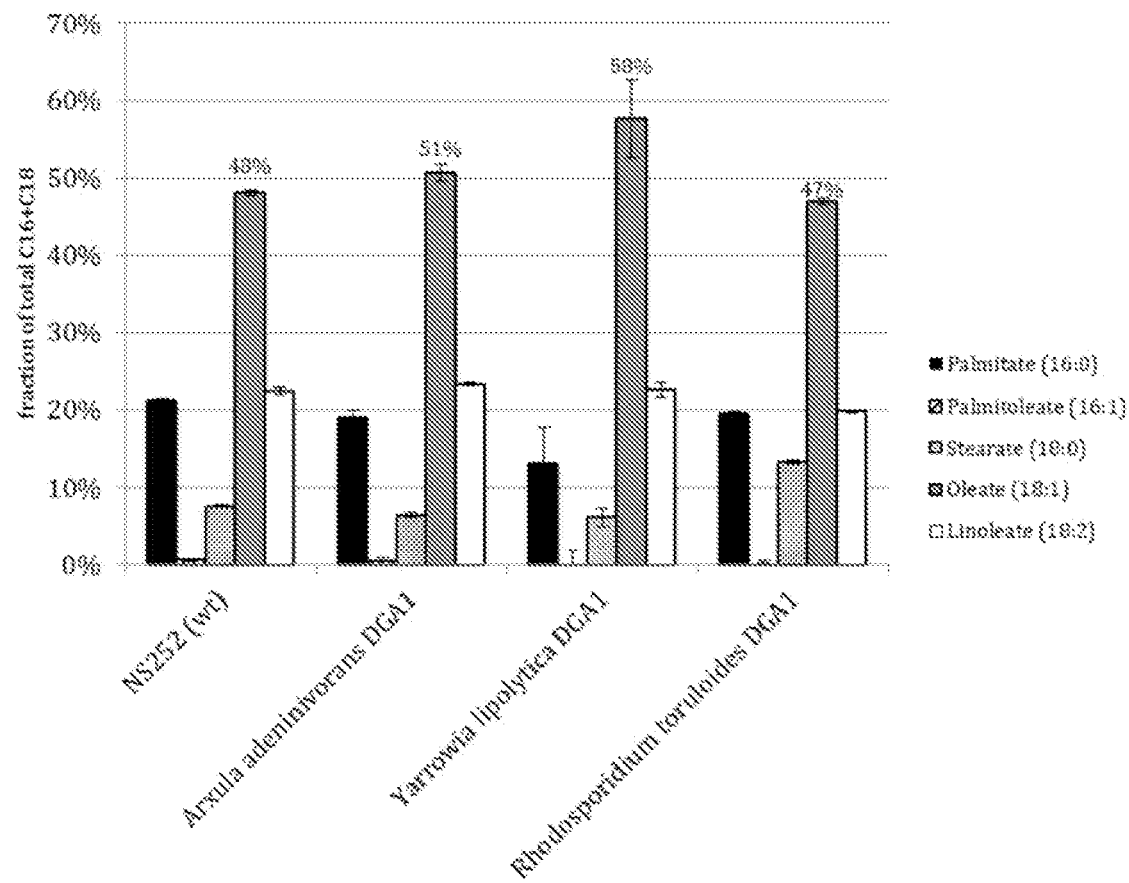
FIG. 4 depicts the percentage of C16 and C18 fatty acids that are palmitate, palmitoleate, stearate, oleate, and linoleate for *A. adeninivorans* strain NS252 after transforming the strain with nucleic acids comprising a DGAT2 gene from various species. The DGAT2 gene encodes the DGA1 protein.

Similar strategies may be used to express the A. adeninivorans DGAT2 gene or other A. adeninivorans gene in Yarrowia lipolytica or another species. Type 2 diacylglycerol acyltransferases from Yarrowia lipolytica (SEQ ID NO:118), Rhodosporidium toruloides (SEQ ID NO: 120), and A. adeninivorans (SEQ ID NO:52) were expressed in A. adeninivorans strain NS252, and the effect of each gene on various C16/C18 lipid fractions is shown in FIG. 4.

Example 9: Analysis and Screening of Yeast that Overexpress DGA1

In order to select strains with the highest lipid production level, Y. lipolytica strain NS18 transformants expressing NG15 (Y. lipolytica DGA1) or NG66 (R. toruloides DGA1) were screened. For NG15, about 50 colonies were screened by a lipid assay for the highest lipid accumulation, and the best transformant was named NS249. For NG66, 80 colonies were screened, and the 8 best colonies were selected for further analysis.

Strain NS249 and the 8 selected NG66 transformants were grown in shake flasks and analyzed by the lipid assay for lipid content and by HPLC for glucose consumption. Y. lipolytica strains overexpressing R. toruloides DGA1 had significantly higher lipid contents than Y. lipolytica strains with a native Y. lipolytica DGAT2 gene expressed under the same promoter as R. toruloides DGAT2. At the same time, NG66 transformants used significantly more glucose than NS249, demonstrating that NG66 was more efficient in converting glucose to lipids. The difference in efficiency between the two DGAT2 genes may be attributed to either a higher level of expression of R. toruloides DGA1 in Y. lipolytica or a higher level of R. toruloides DGA1 specific activity, or both.

Figure 5:
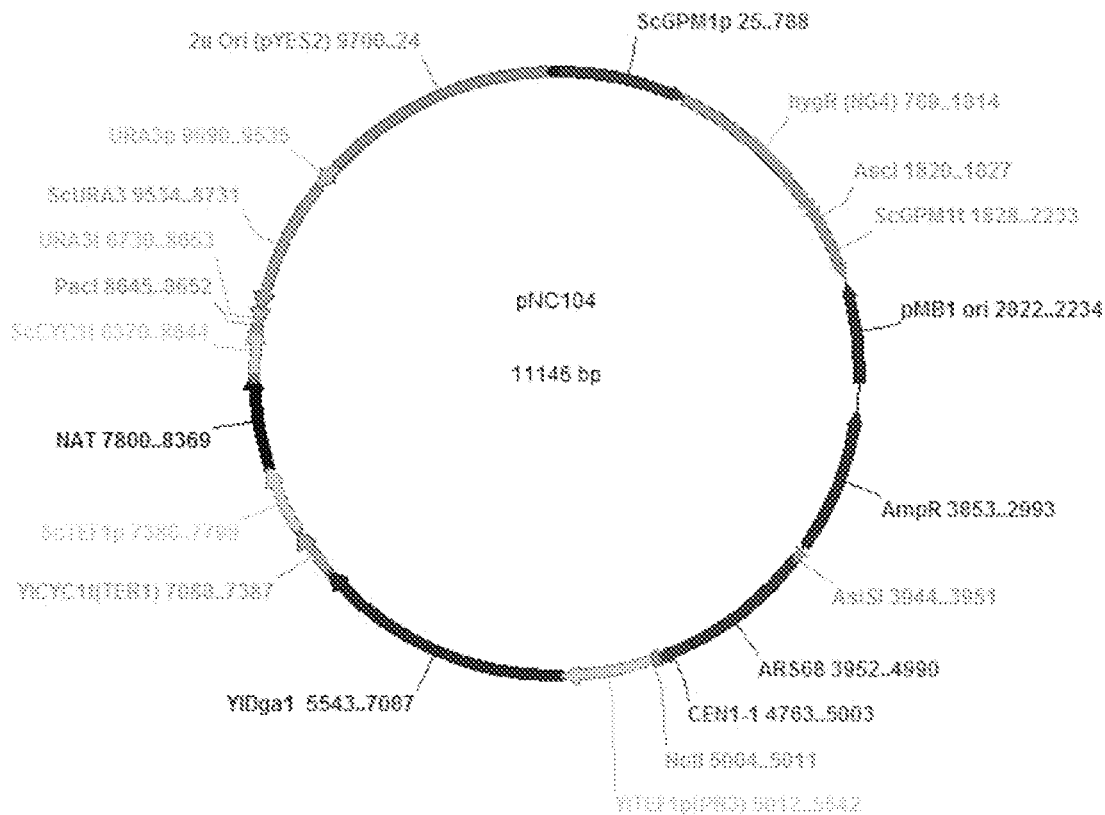
FIG. 5 depicts a map of the pNC104 construct used to overexpress the NG15 gene (YlDga1). Vector pNC243 is linearized by a PacI/NotI restriction digest before transformation. "2u ori" denotes the *S. cerevisiae* origin of replication from the 2 µm circle plasmid; "pMB1 ori" denotes the *E. coli* pMB1 origin of replication from the pBR322 plasmid; "AmpR" denotes the bla gene used as a marker for selection with ampicillin; "ScGPM1p" denotes the *Y. lipolytica* GPD1 promoter −764 to −1; "hygR" denotes the *Escherichia coli* hph gene expression cassette used as marker for selection with hygromycin B; "ScGPM1t" denotes the *S. cerevisiae* GPD1 terminator 406 bp after stop codon: "ARS68" and "CEN1-1" denote *Y. lipolytica* chromosomal origins of replication; "Y1TEF1p" denotes the *Y. lipolytica* TEF promoter −406 to +125; "Y1DGA1" denotes the *Y. lipolytica* DGA1 gene ORF (NG15); "Y1CYC1t" denotes the *Y. lipolytica* CYC1 terminator 300 base pairs after stop; "ScTEF1p" denotes the *S. cerevisiae* TEF1 promoter −412 to −1; "NAT" denotes the *Streptomyces noursei* Nat1 gene used as a marker for selection with nourseothricin; "ScCYC1t" denotes the *S. cerevisiae* CYC1 terminator 275 base pairs after stop; and "URA3p-ScURA3-URA3t" denotes the *S. cerevisiae* URA3 auxotrophic marker for selection in yeast.

Strain NS125 is a derivative of Y. lipolytica strain NS18 (obtained from ARS Culture Collection, NRRL # YB 392) that was transformed with a Y. lipolytica DGA1 expression cassette from the pNC104 vector (FIG. 5). The pNC104 construct was linearized by a PacI/NotI restriction digest prior to transformation. The linear expression construct included the expression cassette for the Y. lipolytica DGAT2 gene and for the Nat1 gene used as a marker for selection with nourseothricin (NAT). The expression construct was randomly integrated into the genome of Y. lipolytica strain NS18 using the transformation protocol as described in Chen (Applied Microbiology & Biotechnology 48:232-35 (1997)). Transformants were selected on YPD plates with 500 μg/mL NAT and screened for the ability to accumulate lipids by a fluorescent staining lipid assay as described in Example 7. The best transformant out of about 100 transformants screened was named NS125.

The NS281 strain was obtained using a similar process as strain NS125, except that the pNC243 construct was used for the transformation of the NS18 strain (FIG. 3). The pNC243 construct contained the Rhodosporidium toruloides DGAT2 gene (NG66) instead of Y. lipolytica DGAT2 gene used to make NS125. The NS281 strain contains a Rhodosporidium toruloides DGAT2 gene that is integrated into the Y. lipolytica genome.

Example 10: Method to Overexpress the DGA2 Protein (DGAT1 Gene)

Several DGAT1 gene sequences that encode DGA2 proteins were selected from public databases and their native intron-free cDNAs were synthesized (GenScript, USA). DGAT1 genes from six selected donors (Yarrowia lipolytica, Rhodosporidium toruloides, Lipomyces starkeyi, Aspergillus terreus, Claviceps purpurea, Chaetomium globosum) were expressed in Y. lipolytica strains NS125 and NS281, which each overexpress a different DGA1 protein. Thus, the method provides an example of increasing the activity of two proteins in the same cell.

Figure 6:
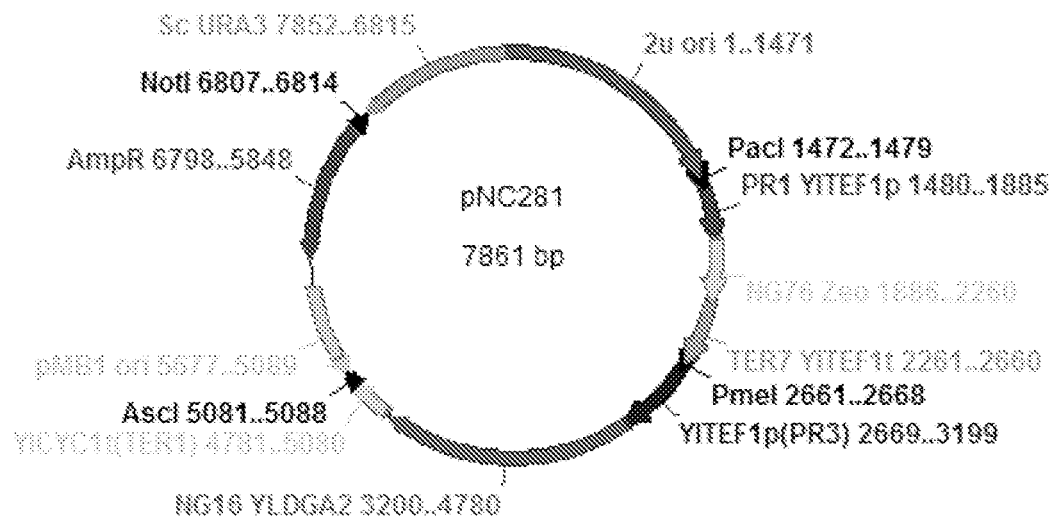
FIG. 6 depicts a map of the pNC281 construct used to overexpress the NG16 gene. Vector pNC281 is linearized by a PacI/AscI restriction digest before transformation. "2u ori"

NS125 and NS281 strains each were transformed with a set of DGA2 expression constructs. FIG. 6 shows the map of the expression construct used to overexpress a Y. lipolytica DGAT1 gene (NG16) in the NS125 and NS281 strains. The constructs for all other DGAT1 genes used were the same except for the DGAT1 ORF. DGAT1 constructs were linearized before transformation by a PacI/AscI restriction digest. The linear expression construct included an expression cassette for the DGAT1 gene and for a BLE gene used as a marker for selection with Zeocin (NG76 ZEO).

For each expression construct, 15 transformants were analyzed by the fluorescent lipid assay described below. In this experiment, the presence of heterologous DGAT1 in *Y. lipolytica* was not confirmed by colony PCR. For most constructs, there was a significant colony variation between transformants, probably due to the lack of a functional DGAT1 expression cassette in some transformants that only obtained a functional ZEO cassette or due to negative effect of the DGAT1 expression cassette site of integration on DGA2 expression. Nevertheless, most of the tested DGAT1 genes increased the lipid content in *Y. lipolytica* beyond the effect displayed by a DGAT2 gene alone. The positive effect of DGA2 overexpression was more noticeable in the NS125 strain background, probably because the NS125 strain, which overexpresses its native DGA1, was less oleaginous than the NS281 strain, which overexpresses a more-highly active DGA1. In both the NS125 and NS281 strains, the NG112 DGAT1 gene (*Claviceps purpurea* DGA2) was the most efficient in increasing the transformants' lipid content, possibly due to a higher expression level and/or higher specific activity compared to other DGAT1 genes tested.

Similar strategies may be used to express the *A. adeninivorans* DGAT1 gene or other *A. adeninivorans* gene in *Yarrowia lipolytica* or another species.

Example 11: Method to Reduce Triacylglycerol Lipase Activity in Yeast

The TGL3 gene was deleted in *Y. lipolytica* wild-type strain NS18 (obtained from NRLL # YB-392) and its DGA1 overexpressing derivative NS281. NS281 overexpresses the DGA1 gene from *Rhodosporidium toruloides* as described above. The *Y. lipolytica* TGL3 gene (YALI0D17534g, SEQ ID NO: 148) was deleted as follows: A two-fragment deletion cassette was amplified by PCR from a plasmid containing the hygromycin resistance gene ("hph," SEQ ID NO: 152) using primer pairs NP1798-NP656 and NP655-NP1799 (SEQ ID NOs: 157, 154, 153, 158). The resulting PCR fragments (SEQ ID NOs: 160 & 161) were co-transformed into NS IS and NS281 according to the protocol developed in U.S. Ser. No. 61/819,746 and PCT Patent Application Publication No. WO14/182657 (both hereby incorporated by reference). The omission of a promoter and terminator in the hph cassette and the splitting of the hph coding sequence into two PCR fragments reduce the probability that random integration of these pieces will confer hygromycin resistance. The hph gene should only be expressed if it integrates at the TGL3 locus by homologous recombination so that the TGL3 promoter and terminator can direct its transcription. Hygromycin resistant colonies were screened by PCR to confirm the absence of TGL3 and the presence of a tgl3::hyg specific product.

Similar strategies may be used to reduce triacylglycerol lipase activity, or the activity of another protein, in *A. adeninivorans* (see Example 13).

Example 12: Method to Reduce Glycerol-3-Phosphate Dehydrogenase Activity in Yeast The GUT2 gene, which encodes glycerol-3-phosphate dehydrogenase, was deleted from *Y. lipolytica* wild-type strain NS18 (obtained from NRLL # YB-392). The *Y. lipolytica* GUT2 gene (YALI0B13970g, SEQ ID NO: 150) was deleted as follows: A two-fragment deletion cassette was amplified by PCR from a plasmid containing the hygromycin resistance gene ("hph," SEQ ID NO: 152) using primer pairs NP1563-NP656 and NP655-NP1800 (SEQ ID NOs: 156, 154, 153, and 159, respectively). The resulting PCR fragments (SEQ ID NOs: 162 & 163) were co-transformed into NS18. The omission of a promoter and terminator in the hph cassette and the splitting of the hph coding sequence into two PCR fragments reduce the probability that random integration of these pieces will confer hygromycin resistance.

*Yarrowia lipolytica* strain NS18 was grown overnight on a YPD plate at 30° C. 1 mL of water was applied to the plate to collect the cells using a L-shaped spreader and pipet. Cells were diluted to $OD_{600}$=0.5 in two flasks each containing 25 mL YPD and shaken at 30° C. for 30 min to acclimate the cells to liquid culture. 95 mg hydroxyurea was added to a final concentration of 50 mM. Shaking was continued for two hours to allow for cell cycle arrest as determined by microscopy (all cells were arrested at the budded stage). Cells were collected by centrifugation, washed with water, and resuspended in a pellet volume of water. 50 µL was aliquoted per transformation, cells were collected by centrifugation, and the supernatant was discarded. The cells were resuspended in 100 µL transformation mix (80 µL of filter sterilized 60% PEG 4000; 5 µL of filter sterilized 2 M lithium acetate, pH adjusted to 6.0; 5 µL of filter sterilized 2 M dithiothreitol (DTT); 10 µL of 2 mg/mL salmon sperm DNA, boiled 10 min prior to use). 9 µL of unpurified PCR product for each of SEQ ID NOs: 162 & 163 was added. The cells were subjected to heat shock at 39° C. for 1 h, collected by centrifugation, resuspended in 1 mL YPD, and cultured overnight at 30° C. to allow hph gene expression. 100 µL of cells was spread onto dry selective plates (YPD/agar containing 300 µg/mL hygromycin) the next day, and transformants were screened for growth on glycerol a day later.

Hygromycin resistant colonies were patched onto minimal media containing glucose or glycerol to screen for isolates that had lost the ability to grow on glycerol due to loss of GUT2 function. Seven correct integrations were obtained when the transformed cells were first arrested in S phase with hydroxyurea (48 colonies screened).

Similar strategies may be used to reduce glycerol-3-phosphate dehydrogenase activity, or the activity of another protein, in *A. adeninivorans* and other species.

Example 13: Method to Reduce Triacylglycerol Acyltransferase Activity in Yeast

In order to test the idea that lipase deletion leads to higher lipid accumulation in *A. adeninivorans*, TGL3 and TGL1 were deleted in *A. adeninivorans* wild-type strain NS252 (obtained from ATCC, #76597). The *A. adeninivorans* TGL3 (SEQ ID NO: 30), TGL4 (SEQ ID NO: 34), and Δ12 desaturase (SEQ ID NO:14) genes were deleted as described in PCT Patent Application Publication No. WO14/182657 (hereby incorporated by reference). Deletion of TGL3 in NS252 resulted in strain NS458. Deletion of TGL4 in NS252 resulted in strain NS481. Deletion of Δ12 in NS252 resulted in strain NS478. These strains were grown using a batch glucose process in 50-mL flasks and lipid content was analyzed by a fluorescence-based assay after 96 hours. Specifically, each flask was filled with 50 mL of filter-sterilized media containing 0.5 g/L urea, 1.5 g/L yeast extract, 0.85 g/L casamino acids, 1.7 g/L YNB (without amino acids and ammonium sulfate), 100 g/L glucose, and 5.11 g/L potassium hydrogen phthalate (25 mM). Yeast strains that had been incubated for 1-2 days on YPD-agar plates at 30° C. were used to inoculate each flask. After 96 hours of incubation with agitation at 30° C., 20 µL of 100% ethanol was added to 20 µL of cells in an analytical microplate and incubated at 4° C. for 30 minutes. 20 µL of cell/ethanol mix was then added to 80 µL of a pre-mixed solution containing 50 µL 1 M potassium iodide, 1 µL 1 mM Bodipy 493/503, 0.5 µL 100% DMSO, 1.5 µL 60% PEG 4000, and 27 µL water in a Costar 96-well, black, clear-bottom plate and covered with a transparent seal. Bodipy fluorescence was monitored with a SpectraMax M2 spectrophotometer (Molecular Devices) kinetic assay at 30° C., and normalized by dividing fluorescence by absorbance at 600 nm. Data was averaged in duplicate growth experiments. Both deletion strains showed increased lipid content compared to the parent strain (FIG. 7).

Example 14: Expressing *A. adeninivorans* Δ9 desaturase in *Y. lipolytica*

The native Δ9 desaturase of *Y. lipolytica* uses both C16 and C18 saturated fatty acids as substrates. *Arxula adeninivorans* Δ9 enzyme was tested for higher C18 specificity by introducing the gene (SEQ ID NO:28) as the sole Δ9 activity in *Y. lipolytica*. This was achieved by first deleting *Y. lipolytica* Δ9 in NS18 to produce strain NS418. NS418 required supplementation with unsaturated fatty acids for growth due to the absence of Δ9 activity. The exogenous Δ9 gene was then inserted into the native locus through targeted integration and selected for the ability to grow without supplementation. Expression of *A. adeninivorans* Δ9 in the absence of the native enzyme resulted in a switch in substrate specificity to overwhelmingly C18:0 substrate, thus reducing C16:1 content to minimal levels (FIG. 8).

Example 15: Expressing *A. adeninivorans* SCT1 in *Y. lipolytica*

The glycerol-3-phosphate acyltransferase SCT1 from *A. adeninivorans* was expressed in a *Y. lipolytica* strain containing a knockout of the native *Y. lipolytica* SCT1 gene. Specifically, the glycerol acyltransferase SCT1 was deleted in *Y. lipolytica* strain NS18 to produce strain NS563, resulting in a lower accumulation of lipids (FIG. 9). The SCT1 gene from *A. adeninivorans* (SEQ ID NO:48) was then expressed in a strain NS563 to produce strain NS804, which produced a *Y. lipolytica* strain that could accumulate more lipids than either strain NS18 or NS563 (FIG. 9).

Example 16: Decreasing the Activity of Various Proteins in *A. adeninivorans*

The native MFE1, TGL3, Δ12, PEX10, POX and TGL4 genes were individually knocked out of wild type *A. adeninivorans* strain 252 using methods similar to those described in PCT Patent Application Publication No. WO14/182657 (hereby incorporated by reference), and the percentage of various C16 and C18 fatty acids, relative to total C16 and C18 fatty acids, for each knockout is shown in FIG. 10.

Example 17: Increasing the Activity of Various Problems in *A. adeninivorans* and *Y. lipolytica*

Eight *Arxula adeninivorans* genes involved in lipid synthesis (Table 3) were selected for overexpression in *Arxula adeninivorans* strain NS252 and *Yarrowia lipolytica* strain NS18. A map of the expression construct used to overexpress the up-regulation targets is shown in FIG. 1, with *Arxula adeninivorans* DGA1 (NG167) as example. The constructs for all other targets were the same, except for the open reading frame. The overexpression constructs were assembled by yeast mediated ligation. The constructs were linearized with a PmeI/AscI restriction digest before transformation. Linear expression constructs included each expression cassette for a genetic target and the *Streptomyces noursei* Nat1 gene, used as marker for selection with nourseothricin (NAT).

TABLE 3

Eight *Arxula adeninivorans* genes involved in lipid synthesis that were expressed in *Arxula adeninivorans* and *Yarrowia lipolytica*.

| Gene ID | SEQ ID NO | Gene Name | Function |
|---|---|---|---|
| NG167 | 16 | DGA1 | diacylglycerol acyltransferase type 2 |
| NG168 | 18 | DGA2 | diacylglycerol acyltransferase type 1 |
| NG170 | 22 | GPD1 | glycerol-3-phosphate dehydrogenase |
| NG177 | 36 | SLC1 | 1-acyl-sn-glycerol-3-phosphate acyltransferase |
| NG183 | 48 | SCT1 | glycerol-3-phosphate acyltransferase |
| NG211 | 104 | ZWF1 | glucose-6-phosphate dehydrogenase |
| NG212 | 106 | GND1 | 6-phosphogluconate dehydrogenase |
| NG218 | 50 | PAH1 | phosphatidate phosphatase |

The expression constructs were randomly integrated into the genome of *Y. lipolytica* strain NS18 (obtained from ARS Culture Collection, NRRL # YB 392) by the transformation protocol described in Chen et al. (Applied Microbiology & Biotechnology 48:232-35 (1997)). The expression constructs were integrated into *A. adeninivorans* (ATCC #76597) using a protocol specifically adapted to *A. adeninivorans*. Briefly, 2 mL of YPD was inoculated with the parent *A. adeninivorans* culture and grown overnight at 37° C. in a rotary shaker. 0.5 mL of the overnight culture was then used to inoculate 25 mL of fresh YPD in a 250 flask, which was then grown at 37° C. for 3.5 to 4 hours. The cells were pelleted at 3000 rpm for 2 minutes, and the supernatant was discarded. The cells were washed in sterile water, and pelleted again at 3000 rpm for 2 minutes. The pellet was suspended in 2 mL of 100 mM lithium acetate comprising 40 µM dithiothreitol and transferred into a microcentrifuge tube. The suspension was incubated for one hour at 37° C. on a rotary shaker. The cells were pelleted at 10,000 rpm for 10 seconds and the supernatant was discarded. The cells were resuspended in 1 mL of water with gentle pipetting, centrifuged again at 10,000 rpm for 10 seconds, and the water was discarded. The cells were washed by pipetting with 1 M cold sorbitol, then centrifuged again at 10,00) rpm for 10 seconds, and the supernatant discarded. 2 mL of cold 1 M sorbitol was added to the pellet, and the tube was placed on ice. 40 µL of the cells were then added to pre-chilled 0.2 cm electroporation cuvettes along with 5 µL of DNA. The cells were electroporated at 25 µF, 200 ohms, 1.5 kV, with a ~4.9-5.0 ms time constant. The cells were added to 1 mL of YPD, incubated at 37° C. overnight, and 100 µL to 500 µL of cells were plated onto YPD agar.

*Y. lipolytica* transformants were selected on YPD plates with 500 µg/mL NAT. *A. adeninivorans* transformants were selected on YPD plates with 50 µg/mL NAT. The transformants for both yeast were screened for the ability to accumulate lipids by the fluorescence lipid assay described above. For each expression construct, eight transformants were analyzed. Parental strains NS18 and NS252 were used as negative controls and analyzed in 4 replicates. The results of the lipid assays are shown in FIG. 11. FIG. 11 demonstrates that *A. adeninivorans* DGA1 and DGA2 have a noticeable effect on lipids at 72 hrs of sampling. At 96 hrs, all eight selected genes increased the lipid contents of *A. adeninivorans*. Interestingly, 4 targets (DGA1, DGA2, SLC1, PAH1), encoding for enzymes involved into the last 3 steps of TAG synthesis, had the largest effect on lipid content in *A. adeninivorans*. In *Y. lipolytica*, only DGA1 and DGA2 had a noticeable positive effect on lipids at 96 hrs.

Example 18: Increasing the activity of ELO1 in *A. adeninivorans*

The *A. adeninivorans* Δ12 desaturase gene (SEQ ID NO: 14) was knocked out of *A. adeninivorans*, resulting in strain NS554, and the *A. adeninivorans* ELO1 gene (SEQ ID NO:72) was overexpressed in the Δ12 knockout background, resulting in strain NS631. The total C16 and C18 lipids were quantified for each strain, and FIG. 12 shows that the *A. adeninivorans* ELO1 gene increased the fraction of C18 lipids in the cell relative to the parent strain NS554.

INCORPORATION BY REFERENCE

All of the U.S. patents and U.S. published patent applications cited herein are hereby incorporated by reference.

EQUIVALENTS

Those skilled in the art will recognize, or be able to ascertain using no more than routine experimentation, many equivalents to the specific embodiments of the invention described herein. Such equivalents are intended to be encompassed by the following claims.

SEQUENCE LISTING (179 sequences)

SEQ ID NO: 1 - protein, 2224 aa, Arxula adeninivorans
MTKSYDHSTLPSHFLGLNSVEAAAASPVRDFVQSHGGHTVISNVLIANNGIAAVKEIRSVRKWAYETFGDERAIKFTVMATPEDLEANADYIRMADKYVEVPGGTNNNNYANVDLIVDVAERTDVQAVWAGWGHASENPLLPESLAASPKKIVFIGPPGSAMRSLGDKISSTIVAQHASVPCIPWSGTGVDEVQVDKNTGLVSVPDDIYQKGCCSGPEDGLAKAKRIGFPVMIKASEGGGGKGIRKVEKEEDFVSAYSQVVGEIPGSPVFIMKLAGNARHLEVQLLADQYGNNISLFGRDCSVQRRHQKIIEEAPVTIAPPDTFSNMEKAAVRLGQLVGYVSAGTVEYLYSHEDDKFYFLELNPRLQVEHPTTEMVTGVNLPAAQLQIAMGIPLHRIKDIRLFYGVDPHTNTEIDYDFSTELGRKSQRRPVPKGHTTACRITSEDPGEGFKPSGGMVHDLNFRSSSNVWGYFSVGNQGGIHSFSDSQFGHIFAFGENRTASRQHMVVALKELSIRGDFRTTVEYLIKLLETPDFEENKITTGWLDELISKRLTAERPDTFVAVICGAVTKAHVESEKSLQEYQQSLEKGQAPTKDTLKSVFAIEFIYEGQRYKFTATRSSPDVYTLFINGSKVEVGVRALSDGGLLVAIDGSSHNVYWKEEVGATRLSVDSMTCLLEVENDPTQLRTPSPGKLVKFLVENGEHVKAGQPYAEVEVMKMYMPLVAQEDGVVQAIKQPGSTLNAGDILGILALDDPSKVKHAQSFEGQLPEYGPPTAAGTKTFQRFHTALKTINNILAGYDNQVVMNSSLKELITVLRNPELPYSEWQHSVSALHSRLPAKLYENLKATVDRAKARKSEFPAKMLLKNFEKFIPTNASDASIFRQSFEPLFDICERYAEGLGAHEFKLMGSLIDKYYSIESLFYGPGVNSQEEDIILKLRDENKSDVRKVIDIVLSHSRIGAKNNLLLAIFNEYQPGKVDSVALVQFLKPVLKKLVDLESRQTAKVVLRAREILIQCALPSLKERTDQLEHILRSSVVENSYGEVGFERRQPNLEVLKEVIDSKYTVFDVLAHFFAHNDPYIVIAAVELYIRRAYRAYSITEVNYHQEVGAIPAVSYKFKLPSPINAAYSATSRDTTTNNNNGKPNVSRAISVSDLTLMADKSDVSPIRVGAMAPAKHVEEMEDALVRALELYPRRGGVEFKAANGPTSSLAAQQRVPQNNNNGPSLLNVCNIAISSADGMDDEELESRVSELVDEYKEELEACSIRRLTFVFGNEQGTYPKYFTYRGPNFVEDKTIRHIEPALAFQLELGRLSNFDIRPVFTENRNIHVYEAVAKNSSSDKRFFTRGIVRPGRIREDISTPQYLISEANRLMTDILDALEVIDTTNSDLNHIFINFTAVFPLVPEEVENAFGGFLERFGRRLWRLRVTGAEIRIMITDPTTGVNFPLRAMINNVSGYVVKSELYAEIKNDKGEWIFKSLGKPGNMHLRPVSTPYPTKEWLQPKRYKAHLMGTTYCYDFPDLFRQAILSRWEKLLPGQKAPEDVAQFSELILDEAGQLSEVSREPGANNVGMVAWKFTAKTPEYPRGRKFIVIANDITYKIGSFGPQEDHFFNAVTELARAEGIPRVYLSANSGARIGVAEELIPLFSVAWKDPEDSSKGFDYLYLTPENYERASKSAKKSVECEKVVENGETRYKILYIIGADDGLGVECLRGSGLIAGATSRAYKDIFTITLVTCRSVGIGAYLVRLGQRAIQIEGQPIILTGAPAINKLLGREVYTSNLQLGGTQIMYRNGVSHLTANDDLAGVERIMDWMSYIPAQRGLPVPIVETGDAWDRDVDYVPPQQGAYDVRWMIAGRQDESGQFEAGLFDKDSFQETLSGWAKGVVVGRARLGGIPFGVIAVETRAVDNVFPADPANPDSTEMKVQEAGQVWYPNSAFKTAQAINDFNHGEELPLMILANWRGFSGGQRDMYNEVLKYGSYIVDALVGYKQPILTYIPPHGELRGGSWVVVDPTINSDMMEMYADVESRAGVLEPEGMVGIKFRRDKLLATMKRLDTKYAELCRQSEDKELSEEERSKIKVALNEREKTLLPVYQQISVQFADLHDRSGRMAAKGTIRKELEWVNARRFFFWRIRRRLNEEYLLKAIRDALPKSTRLEQMARIKAFYTSEVSDVEDDRAVAEFLEAQHDKVTAKIAQLKKDNLVQSAVSALKGLSDKEREEVLRNL

SEQ ID NO: 2 - DNA, 6675 bp, Arxula adeninivorans
atgacaaaatcttacgatcactctactctaccttcccactttttgggactcaattctgtggaggccgctgccgcctcccccgtgagagattttgtccaatctcacggaggtcacactgtcatcagcaacgtgctgattgctaacaacggtattgctgccgtcaaggagattcggtcggtgcgaaaatgggcctacgagacgtttggcgacgagcgggccatcaagttcaccgtcatggccacccctgaggatctggaggccaatgccgactacattcgaatggcagacaagtacgtggaggtgccaggaggaacaaataacaacaactatgctaacgtggacctcattgtcgacgtggccgagcgcactgacgtccaggcggtgtgggccggatggggtcacgcatccgagaaccctctgctgccagagtccctggccgcttccccaaagaagattgtgttcattggaccccccggatccgccatgcgatccctcggagataagatctcttccaccattgtcgcccagcatgccagtgtgccctgtatcccctggtccggaaccggcgtggacgaggtccaggtcgacaagaacaccggtctggtgtctgtgccagacgacatttaccaaaagggctgctgctcgggccctgaggatggcctggccaaggcaaagcgaattggcttccccgtcatgatcaaagcgtcagaaggaggtggaggaaaaggaatcagaaaggtcgaaaaagaggaggactttgtgtccgcctactcccaagtggtgggtgagattcctggttcccccgtcttcattatgaagctggctggcaacgcccgtcacttggaggtccagctgctggctgaccagtacggaaacaacatctccctgtttggtcgagactgttccgtccagcgtcgtcaccaaaagatcatcgaggaggcccccgtcacaattgccccgcctgacaccttctccaacatggagaaggctgccgtccgtctcggtcagctggtaggctacgtgtctgccggtaccgtcgagtacctgtactcccacgaagatgacaagttctacttcctggagcttaacccccgtctgcaggtcgagcaccctaccaccgagatggtgactggtgtgaacctccctgctgcccagctccagattgccatgggtatccccttgcaccgaatcaaggacattcgtctcttctacggtgtcgaccctcacaccaacactgagattgactacgactttagcaccgagctcggccgcaagtcccagcgtcgtcctgtgcccaagggtcacactaccgcttgccgaatcacctctgaggaccccggtgagggtttcaagccctcgggaggtatggtccacgacctcaacttccgttcttcttccaacgtgtggggttacttctcggtcggaaaccagggaggaatccactccttctcggactcgcagtttggtcacattttcgcctttggtgagaaccgaaccgcttcccgccagcacatggtcgtcgctctcaaggaattgtccattcgaggtgacttccgaactactgtcgagtacctgatcaagctgctggagactcctgactttgaggagaacaagatcaccaccggatggctggacgagctcatctccaagcgtctgaccgccgagcgccctgatacttttgtggctgtcatctgtggtgccgtgaccaaggctcacgttgaaagcgaaaagtcgctccaggagtaccagcagtcgctggagaagggtcaggcccctaccaaggacaccctcaagtcggtgtttgccattgagttcatttacgagggccagcgatacaagttcaccgccacccgctcttcgcctgatgtgtacactctgttcatcaacggatccaaggtcgaagtgggcgtgcgcgctctttccgacggtggtctgttggtcgctattgacggaagctcccacaacgtgtactggaaggaggaagtcggggccacccgtctgtctgttgactccatgacctgtctgctcgaggtcgagaacgaccctacccagcttcgtactccctctcccggaaagcttgtcaagttcctggtcgagaacggggagcacgtcaaggccggtcaaccctacgctgaagtggaggtcatgaagatgtacatgcccctggttgctcaggaggatggtgtggtccaggccatcaagcagcccggatctactcttaatgccggagacattctcggaattctggctctcgatgatccttccaaggtgaagcacgctcagtcgtttgagggtcagctccccgagtacggcccccctaccgccgccggaaccaagaccttccagcgattccacaccgctctcaagacaatcaacaacattttggctggttacgacaaccaggtggtcatgaactcgtctctcaaggagctcatcaccgtcctccgcaaccccgagcttccttactctgagtggcagcactcggtctctgctctgcactctcgtctgcccgcaaagctgtacgagaacctcaaggctaccgtagaccgcgccaaggcccgcaagagcgagttccctgcaaagatgcttctcaagaactttgaaaagttcattcctaccaacgctagcgatgcatccatcttccgccagtcgtttgagcctctgtttgacatttgcgagcgctacgccgagggacttggtgctcacgagttcaagctcatgggctctttgatcgacaagtactacagcattgaatctctgttctacggccctggcgttaacagccaggaggaggacattatcctcaagctgcgagacgagaacaagagtgacgtgcgcaaggttatcgacattgtgctttcccactcgcgaattggcgcaaagaacaacctcctgctggccatcttcaacgagtaccagcctggcaaggttgacagtgttgcgctggttcagttcctcaagcctgttctcaagaagctggtagacctcgagtctcgccagaccgcaaaggttgtgctgcgcgcacgagagattctcattcagtgcgccctgccctcgctgaaggagcgtaccgaccagctcgagcacattctgcgctcgtctgtggttgagaactcttacggagaggttggcttcgagcgccgccagcctaaccttgaggtcctcaaggaggtgattgactcaaagtacactgtgtttgacgtgctggctcacttctttgctcacaacgatccttacattgttattgctgccgtcgagctgtacattcgtcgtgcttaccgtgcctactccattactgaggtcaactaccaccaggaggtcggtgccattcctgctgtgagctacaagttcaagctgccttcgcccatcaacgctgcctacagcgctacctctcgcgacactactaccaacaacaacaatggcaagcccaacgtttctcgagccatttctgtgtcggatctgaccctgatggctgacaagagcgacgtgtcccccattcgtgtgggtgctatggctcctgctaagcatgttgaagagatggaagacgctttggtcagagctctcgagctttatcctcgccgaggaggcgttgagttcaaggctgccaacggacctacttcgtccctggccgctcagcagcgagtgcctcagaacaacaacaacggccccagcctgctcaacgtgtgcaacattgccattagcagcgccgatggaatggatgacgaagagttggagagccgtgttagcgagcttgtagacgagtacaaggaggagctggaagcttgctccatccgtcgtctcacctttgtgtttggtaacgaacagggcacttaccccaagtactttacctaccgaggccccaactttgtggaggacaagactattcgacacattgagcctgctctggcgttccagcttgagctgggacgtctgtccaactttgacattcgacccgtcttcactgagaaccgtaacatccacgtgtacgaggcggttgctaagaactcgtcgtccgacaagcgattcttcactcgaggaatcgtgcgacctggccgcattcgcgaagacatttccactcctcagtacctgatttcggaggccaaccgtctcatgactgatattctggacgctctggaggtgattgacaccacaaactccgatctcaaccacattttcatcaacttcactgctgttttccctctggttcctgaggaggtggagaatgcttttggaggattcttggagcgatttggccgacgtctgtggcgtctgcgtgtcactggtgctgaaatccgcatcatgattactgaccccactactggtgtcaacttccctctgcgagccatgatcaacaacgtgtctggttacgtggtcaagagcgagctttacgctgagatcaagaacgacaagggcgagtggatcttcaagtcgttgggcaagcctggtaacatgcacctgcgaccagtgtctactccctaccctaccaaggagtggctgcagcctaagcgatacaaggcccatctcatgggtaccacctactgctacgacttccctgatctgttccgccaggcaattctgtcgcgatgggagaagctgctgcctggccagaaggctcctgaggacgttgcccagttctcggagctcatcctcgacgaggccggacagctgtccgaggtgtctcgagagcctggtgccaacaatgttggaatggtggcctggaagttcactgcaaagactcctgagtaccctcgcggccgaaagttcattgtcattgccaatgatatcacctacaagattggatccttcggacctcaggaggaccacttcttcaatgctgtcaccgagttggcccgtgccgagggtatcccccgagtatacctgtctgccaactctggagctcgaattggtgttgccgaggagctcattcctctgttctcggtggcttggaaggaccctgaggactcttccaagggctttgactacctgtacctgacccctgagaactacgagcgagcatccaagtccgctaagaagtctgtcgagtgcgagaaggttgtcgagaacggagagacccgatacaagatcctttacattatcggagctgatgacggactcggagtggagtgtctgcggggatctggtctcattgccggagctacttcgcgagcctacaaggatatcttcaccatcacccttgtcacctgccgatccgttggtatcggtgcctacctggtccgactgggtcagcgagccatccagattgagggtcagcctatcatcttgaccggagctcctgccatcaacaagcttctgggtcgtgaggtgtacacttccaacctccagcttggaggaacccagattatgtaccgaaatggtgtctcccacttgactgccaacgacgatttggccggtgtggagcgcatcatggactggatgtcgtacattcctgcccagcgtggtctgcctgtccccattgtagagactggtgacgcctgggaccgtgatgtggactacgttcctcctcagcagggtgcttacgatgtcagatggatgattgctggacgacaagacgagagtggccagtttgaggcaggtcttttcgacaaggactccttccaggagactctgagcggatgggccaagggagttgtcgtaggacgagctcgtcttggtggcattcctttcggagtgattgctgttgagacccgcgctgtggacaatgtgttccctgccgaccctgccaaccctgattccactgaaatgaaggtccaggaggctggtcaggtttggtaccccaacagtgccttcaagaccgcccaggccattaacgacttcaaccacggagaggagcttcctctgatgattctggccaactggcgaggattctcgggtggtcagcgtgacatgtacaacgaggttctcaagtacggatcgtacattgtcgatgctctggtgggatacaagcagcccatcctcacctacattccccctcacggagagctgcgaggaggttcgtgggtggtggtcgaccctaccatcaactctgacatgatggagatgtacgctgacgtggagtctcgcgctggtgtgctggagcctgagggaatggttggaatcaagttccgacgagacaagttgctggctaccatgaagcgattggacaccaagtacgctgagctgtgccgacagtctgaggacaaggagctcagcgaggaggagcgatctaagatcaaggttgccctcaacgagcgagagaagactctgctgcccgtgtaccagcagatttctgtccagtttgccgacttgcatgaccgatctggacgaatggctgccaagggcaccatccgaaaggaactggaatgggttaacgcccgacgattcttcttctggcgtatccgtcgtcgtctcaacgaggagtacttgctcaaggctatccgcgacgcattgcccaagagcactcgtctggaacagatggctcgcatcaaggccttctacacttcggaggtgtctgatgtcgaggatgaccgtgccgtggccgagttcctggaggctcagcatgacaaggttactgctaagattgcacagctcaagaaggacaacttggtgcagtctgcagtgtctgctctcaagggactgagcgacaaggagcgtgaggaagtgcttcgaaacctctaa

SEQ ID NO: 3 - protein, 651 aa, Arxula adeninivorans
MSANEKIERFNAPQSGASAPYELFSEHTRAFVYGLQPRACQGMLDFDFICKREVPSVAGIIYPFGGQFVSKMYWGTKETLLPVYQQVEKAAAKHPEVDVVVNFASSRSVYSSTMELLEYPQFRTIAIIAEGVPERRAREILHKANKKGVTIIGPATVGGIKPGCFKIGNTGGMMDNIVSSKLYRPGSVAYVSKSGGMSNELNNIISQTTDGVYEGVAIGGDRYPGTTFIDHILRFQADPKCKIIVLLGEVGGVEEYRVIDAIKKGLITKPIVAWAIGTCAAMFTTEVQFGHAGSMANSDMETAVAKNRAMKEAGIYVPDTFEDMPELLNTVYQGLVKKGSIVPQPEPEVPKIPIDYSWAQELGLIRKPAAFISTISDDRGQELLYAGIPISEVFKEDVGVGGVMSLLWFRRRLPAYAAKFLEMVLMLTADHGPAVSGAMNTIITTRAGKDLISSLVSGLLTIGTRFGGALDGAATEFTTAFDKGWSPRQFVDTMRKQNKLIPGIGHKVKSRNNPDFRVELVKEYVKNNFPSTTLLDYALAVEEVTTSKKDNLILNVDGAIAVSFVDLMRSCGAFTAEEVEDYLRNGVLNGLFVLGRSIGLIAHHLDQKRLKTGLYRHPWDDITYLVGQEAVQTSNKRVEVDAKGVSKAKAK

SEQ ID NO: 4 - DNA, 1956 bp, Arxula adeninivorans
atgtcggcaaacgaaaagattgaacgcttcaatgcccctcagtcgggagcgtctgccccttacgagctgttcagcgagcacacccgtgcgtttgtgtacgggttgcagccacgagcgtgccagggcatgctggactttgacttcatttgcaagcgagaggtgccctcggtagccggtatcatctacccatttggcggtcaatttgtgtccaagatgtactggggaaccaaggagacccttctgccggtgtaccagcaggtcgagaaggccgctgctaagcaccctgaggtggacgttgtggtcaactttgcctcttcccgttcggtgtactcgtcgaccatggaattgctcgagtaccctcagttccgaaccattgccatcattgccgagggagtgcccgagcgacgtgctcgcgagattctccacaaggctaacaagaagggagtgaccatcattggtcctgccactgtgggaggaatcaagcctggatgcttcaagattggaaataccggaggaatgatggacaacattgtgtcgtccaagctgtaccgacccggttcggtggcctacgtgtccaagtctggaggaatgtccaacgagctcaacaacatcatctcccagaccaccgacggagtgtacgagggagtggctattggaggagaccgttacccaggaaccaccttcattgaccacattctgcgattccaggcagaccccaagtgcaagatcattgtgctgctgggagaagtcggcggtgtcgaggagtaccgtgtcattgacgccatcaagaagggactcatcacaaagcccattgttgcgtgggccattggaacctgtgctgccatgttcaccaccgaggtgcagtttggacacgccggatccatggctaactctgacatggagactgctgtcgctaagaaccgagccatgaaggaggccggaatctatgttcctgacacttttgaggatatgcccgagctgctcaacactgtgtaccagggtctggtcaagaagggatccattgtccctcagcccgaacctgaagtgcccaagatccccattgactactcgtgggctcaggagctgggtctgatccgaaagcccgctgcgttcatctccaccatttccgacgaccgaggacaggagcttctgtacgccggaatccccatttcggaggtgttcaaggaggacgttggagtcggaggagtcatgtcgctgctgtggttccgacgtcgtctgcctgcgtacgctgcaaagttcctggaaatggtgctcatgctcactgccgaccacggtcctgcggtgtccggagcaatgaacaccattatcaccactcgtgccggaaaggacctcatctcgtctctggtgtccggtctgctgaccattggaactcgattcggaggagctctggacggcgctgccaccgagtttaccaccgcattcgacaagggctggtcgcctcgtcagtttgtggacaccatgcgaaagcagaacaagctcatccccggtattggacacaaggtcaagtcgcgaaataaccccgatttccgagtggagctggtcaaggagtacgtcaagaacaacttcccctccaccactctgctggactacgctctggccgtggaggaggtgaccacttccaagaaggacaacctgattctgaacgtggacggagccattgcggtttcgtttgtggacctcatgagatcgtgtggtgcgttcactgctgaggaggttgaggactacctccgcaacggagtgctcaacggtctgttcgtgctgggacgttccattggtctcattgctcaccacctggaccagaagcgtctcaagactggtctgtaccgacacccttgggatgacattacctacctggtaggccaggaggcagtccagacatccaacaagcgagtggaggttgatgctaagggagtgtccaaggccaaggccaagtaa

SEQ ID NO: 5 - protein, 496 aa, Arxula adeninivorans
MSAKSIHEADGKALLSYFLDKSPVYSKTQPATSFTSSTPKLASLTFEDEASIDKVFAEAEKTYPWLLASGAKFVAKPDQLIKRRGKSGLLALNKSWEEAKAWIAERAAKPVKVEHVTGTLRTFLVEPFVPHEQKHEYYINIHSVREGDWILFYHEGGVDVGDVDSKASKILIPVDIENEYPSNEEITKALFSQCPQDQHQTLVDFVNRLYAVYVDLQFTYLEINPLVVIPTASGVEVHYLDLAGKLDQTAEFECGPKWAVARSPAALGQVVSSSSESKVSIDAGPAMEFPAPFGRELSKEEAYIAELDSKTGASLKLTVLNSKGRIWTLVAGGGASVVYADAIASAGYASELANYGEYSGAPNEVQTYEYAKTVLDLMTRGEPVPEGKVLFIGGGIANFTQVGSTFKGIIRAFRDFKTLLHTHKVKIYIRRGGPNWQEGLRLIKNAGEELDLPMEIYGPDMHVSGIVPLALNDKRPKGVQQFGVSSTTAPSTPLST

SEQ ID NO: 6 - DNA, 1491 bp, Arxula adeninivorans
atgtctgccaaatcgattcatgaggccgacggcaaggctctgctgtcctatttcctcgacaagagccccgtgtacagcaagactcagcccgctacctcgttcacctcgtcgaccccgaagctggcttcgctgacgtttgaggacgaggcctcaattgacaaggtgttcgccgaggccgagaagacctacccctggctgcttgcttctggagcaaagtttgtggcaaagcccgaccagctcatcaagcgacgaggcaagtctggtctgctggcactgaacaagagctgggaggaggcaaaggcgtggatcgccgagcgggctgctaaacccgtcaaggtcgagcacgtcactggaaccctgcgaaccttcctggtcgagccttttgtgccccacgagcagaagcacgagtactacattaacattcattcggtgcgagagggagactggattctgttctaccacgagggaggagtggacgttggtgatgtggactccaaggcatccaagattctcattcccgtagacattgaaaacgaatacccctcgaacgaggagatcacaaaggccctgttctcccagtgcccccaggaccagcaccagaccttggtggactttgtcaaccgtctgtatgcggtgtacgtggacctgcagtttacttacctggaaatcaaccctctggtggtgatccccactgcctcgggtgtggaggtgcactaccttgatctggctggaaagcttgaccagaccgccgagtttgagtgcggaccaaagtgggctgttgcccgttctcctgccgccctgggccaggttgtgtcttcttcttccgagtccaaggtcagcattgacgccggtcctgccatggagttccctgctcccttcggccgagagctgtccaaggaggaggcatacattgctgagctggactccaagactggagcttcgctcaagctgaccgtgctcaactccaagggccgtatctggactctggtggccggaggtggtgcgtctgtggtgtacgccgacgccattgcgtctgccggttacgccagcgagctcgcaaactacggagagtactcgggtgcccccaacgaggtgcagacgtacgagtacgcaaagacggtgctggacctcatgacccgaggcgaacccgtgcccgagggcaaggttctgttcattggaggaggaattgctaacttcacccaggtcggttccactttcaagggaatcattcgcgccttccgcgactttaagactctgctccacacccacaaggtcaagatttacattcgacgaggaggtcccaactggcaggagggtctgcgtctgatcaagaacgctggagaggagcttgacctgcccatggagatttacggacctgacatgcacgtttcaggaattgtgcctctggctctcaacgacaagcgacccaagggcgtccagcagtttggcgtatcctccaccaccgctccttccactcctctgtcgacctaa

SEQ ID NO: 7 - protein, 661 aa, Arxula adeninivorans
MSAPVVAEAHGIEKVPVPDHFHNNHPGRAHLKNAQDYERMYKQSISDPDQFWGGMARDLLSWDRDFETVRKGGFETGDVAWFLEGRLNACYNAVDRHAIANPDKVAIIYEADEPGKGRKITYSELLGEICRVAQVLKSMGVKKGDTVAVYLPMVPEVVVTILAIARLGAVHSVVFAGFSAGSLRDRIVDADSHVVITADESVRGGKVIETKKIVDEALKQSPGVEHVLVLRRTGKQVPFTEGRDKWWHEEVVKHRPYCPPEPVSAEDPLFLLYTSGSTGKPKGVAHATGGYLLGAATTTRYVFDLHHHDILFTAGDVGWITGHTYVLYGPLLLGATTVVFEGTPAYPNFSRYWDIVDAHKVTHFYVAPTALRLLKRAGTQHIHHDLSSLRTLGSVGEPIAPDVWQWYNDNIGKGRAHICDTYWQTETGSHIISPMAGVTATKPGSASFPMFGIDPVIIDPVSGKELEGNDVEGVLAIRSPWPSMARTVWGAHERYLDTYFKPYPGYYFTGDGAGRDHEGYYWIRGRVDDVVNVSGHRLSTAEIEAALIEHKDVAESAVVGVADELTGQAVNAFVSLKTSVSDVEAAKKEMVLQVRKEIGPFAAPKTILLVDDLPKTRSGKIMRRILRKVLAGEEDQLGDISTLSNPDVVAHIIDVVHASRK

SEQ ID NO: 8 - DNA, 1986 bp, Arxula adeninivorans
atgtccgctccggtagtagcagaggcccacgggatcgagaaggtaccagtccccgaccactttcacaacaatcaccctggcagagctcacctgaagaatgctcaggactatgagcgtatgtacaagcagtccatctctgacccagaccagttctggggaggcatggcccgcgatctgctgtcgtgggatcgggactttgagactgtccgcaagggagggtttgagactggagacgtggcgtggttcttggagggtcgactaaacgcctgctacaacgcggtcgaccgtcacgccattgccaaccccgacaaggttgctatcatctacgaggctgatgagccaggcaagggccgaaagatcacttactcggagctgctgggggagatttgcagagtggcccaggtgctaaagtccatgggcgtcaagaagggcgacaccgtggccgtgtacctgcccatggttcctgaggtggtggtgaccattctggccattgcccgtctgggtgccgtccactcggtggtgtttgccggattctctgctggatcgctgcgagaccgaattgtggacgccgattcgcacgtagtcatcactgccgacgagtctgtgcgaggaggaaaggtcattgagaccaagaagattgtcgatgaggctctcaagcagtcccccggcgtggagcacgttttggtgctgcgacgaactggcaagcaggtgcccttcaccgagggtcgggacaagtggtggcacgaggaggtggtcaagcaccgcccttactgccctcctgagccagtgtcggccgaggaccctctgttcctgctgtacacttctggttccactggaaagcccaagggtgtggcccatgccactggtggttacctgctaggcgctgccaccaccacccgatatgtatttgacctccatcaccacgatattttgttcaccgctggagacgtgggctggattaccggtcacacctacgtgctgtacggtcccctgctgctgggagctactacagtagtgtttgagggtactcctgcctaccccaacttttcccgatactgggacattgtggacgcacacaaggtgactcacttctacgttgctcctactgccctgcgtctgctcaagcgagcaggcacccagcacattcaccacgatctctcttccctgcgaaccctgggatcggtaggtgaacccattgctcctgatgtgtggcagtggtacaatgacaacattggaaagggccgagctcacatttgcgatacttactggcagaccgagactggttcccacattatctcccccatggccggtgtcactgccaccaagcctggtagtgcatctttcccaatgtttggaattgaccctgtcatcatcgaccccgtgtccggaaaggagctcgagggcaatgacgtcgagggtgtattggccattcgctctccctggccctctatggctcgaaccgtctggggcgctcacgagcgctacctcgacacctacttcaagccctaccccggttactactttactggagatggtgccggacgggaccatgaaggttactactggatccgtggtcgagtggatgatgtggtcaacgtgtctggtcaccgactgtccactgccgagattgaggccgctctcatcgagcacaaggatgttgccgagtctgctgtagtaggtgttgccgatgagctcaccggtcaggccgtcaacgcatttgtgtctctcaagacctcagtgtccgatgtggaggctgccaagaaggagatggtcctccaggtccgaaaggagattggtcctttcgcagctcctaagaccattctgctggtggatgatttgcccaagactcgatctggaaagatcatgcgtcgtattctgagaaaggtcctggctggagaagaagaccagttgggtgacatttccaccctttccaaccccgacgttgttgcgcacattattgacgttgttcatgcttccagaaagtag

SEQ ID NO: 9 - protein, 657 aa, Arxula adeninivorans
MPVSDARPTPKQYYESHPAKPHIDGIDHYEELYNASVKQPEVFFANQARELLSWDRDFKSTHSGGFEFGDMSWFQEGTLNAAYNCVDRHAIATPNKAAIIYEADEPSESRTITYGELYRDVCRVAAVLAQDFGVKKGDTVAVYMPMIPETVVAILAVARLGAIHSVVFAGFSSGSLQDRINNAKSKVVITVNEGRRGGKTVHAKKIVDDALENTPSVEKVLVFQRTSNNVSMVQGRDHWWHEAIEYKRPVFPHVPVNAEDPLFLLYTSGSTGAPKGVVHSTGGYLLGAAMTTRYVFDIHDDDILFTAGDVGWITGHTYALYGPLLLGSTSVIFEGTPAYPDYGRYWQIVEKYKVTQFYVAPTALRLLKKAGVDHIEKYDLSSLRTLGSVGEPISPELWEWYHKHVGREVCHVSDTYWQTETGSHIIAPLSGVISMKPGSATLPFFGIDLAIIDPVSGKEIEGNDVEGVLAIRKPWPSMARSVYGDHKRFMETYLKPYPGYYFTGDGAYRDKDGYYWIRGRVDDVVNVSGHRLSTSEIEASLLGAPSVSEAAVVGIADELTGQAVVAFTSVKGDDVSAEDALAQKKRLIMHVRGEIGPFAAPKTVIIVDDLPKTRSGKIMRRILRKIVSNEVDSIGDISTLMNPGCVEDIINAVKQQL

SEQ ID NO: 10 - DNA, 2156 bp, Arxula adeninivorans
atgcctgtctccgacgctagacctactcctaagcaatactacgaatctcacccggcaaagcctcatatcgatggcattgaccactacgaggaattgtacaatgcctcggtcaagcagcctgaggtctttttcgccaaccaggcacgagagctcttgtcttgggaccgggatttcaaatccacccactccggaggatttgaattcggcgacatgagctggttccaggagggtactctcaacgcagcatacaactgtgtggaccgacatgcaattgctacccccaataaggtaagtaatccattttcctgatcccggttggaacgtttttttcttttccttagcccatgagtggacaaattgttgggttgcatgctctttgctgcaggctgccgccgccgcggttgatggggcatgtatgcattcctcgacaacggtttttagggcgtttttgatagggtactaacatttaggctgcaattatctacgaagctgatgagccttcggaatctcgaacaatcacctatggtgagctgtaccgagatgtgtgccgggtagccgcggtgctcgcccaggactttggtgtaaagaagggcgacactgttgcggtgtacatgcccatgatccccgagactgtggttgcaatcttggcagttgcacgactgggcgcaattcactcggtcgtgtttgccggtttctcttctggctcgctgcaggaccgaattaacaatgccaaatcaaaggtcgtcatcaccgtcaacgagggtcgacgaggaggaaagaccgttcacgctaagaagattgtagacgacgctttggagaacactccttcggtcgagaaggtgctcgttttccagcgcacttccaacaatgtgtcaatggtccagggacgagaccactggtggcatgaagcaatcgaatacaagcgaccagttttccctcacgtgcctgtcaacgctgaggaccctctgttcctgctgtacacttccggttccactggagctcctaagggagttgtgcattctaccggaggatacctgctgggagctgctatgactactcgatacgtattcgatatccacgatgatgacattctgttcaccgctggagatgtcggttggattactggtcacacttacgctttgtacggacccctgcttttgggatccacttcggtcatctttgagggtactcctgcctaccctgactacggccgatactggcagattgttgaaaagtacaaggtcacccagttctacgtggctcctactgctctgcgtctgctcaagaaggccggggtggaccacattgaaaagtacgatctgtctagtctgcgaactctgggatcagtgggtgagcccatttcccctgagctgtgggagtggtaccacaagcacgttggtcgcgaggtttgccacgtttctgacacttactggcagactgagactggatcccacattatcgctcccctgtccggtgtgatttccatgaagcccggttcggctactctgcccttctttggtatcgaccttgctatcattgaccctgtgtctggcaaggagattgagggcaacgacgtagagggagtgctggccattcgaaagccctggccttcgatggctcgctctgtgtacggtgaccacaagcgattcatggagacttacctcaagccataccccggctactactttactggagatggtgcttaccgagacaaggacggttactactggatccgtggccgtgttgacgacgttgttaacgtgtctggacaccgtctgtctacttcggagattgaggcctctctgctgggagctccttctgtttccgaggctgctgtggtcggaattgctgacgagctcaccggacaggccgtggtggctttcaccagtgtaaagggtgacgacgtttccgcagaagacgccctggctcagaagaagcgattgattatgcatgttcgtggagagattggtccctttgctgctcccaagactgtcatcattgtggacgacctgcccaagacccgatcaggcaagatcatgcgacgaattctgcgcaagattgtctccaacgaggttgattccattggagacattagcacgctcatgaaccctggatgtgtagaggacatcatcaacgccgtcaagcagcagttataa

SEQ ID NO: 11 - protein, 657 aa, Arxula adeninivorans; identical to SEQ ID NO: 9

SEQ ID NO: 12 - DNA, 1974 bp, Arxula adeninivorans
atgcctgtctccgacgctagacctactcctaagcaatactacgaatctcacccggcaaagcctcatatcgatggcattgaccactacgaggaattgtacaatgcctcggtcaagcagcctgaggtctttttcgccaaccaggcacgagagctcttgtcttgggaccgggatttcaaatccacccactccggaggatttgaattcggcgacatgagctggttccaggagggtactctcaacgcagcatacaactgtgtggaccgacatgcaattgctacccccaataaggctgcaattatctacgaagctgatgagccttcggaatctcgaacaatcacctatggtgagctgtaccgagatgtgtgccgggtagccgcggtgctcgcccaggactttggtgtaaagaagggcgacactgttgcggtgtacatgcccatgatccccgagactgtggttgcaatcttggcagttgcacgactgggcgcaattcactcggtcgtgtttgccggtttctcttctggctcgctgcaggaccgaattaacaatgccaaatcaaaggtcgtcatcaccgtcaacgagggtcgacgaggaggaaagaccgttcacgctaagaagattgtagacgacgctttggagaacactccttcggtcgagaaggtgctcgttttccagcgcacttccaacaatgtgtcaatggtccagggacgagaccactggtggcatgaagcaatcgaatacaagcgaccagttttccctcacgtgcctgtcaacgctgaggaccctctgttcctgctgtacacttccggttccactggagctcctaagggagttgtgcattctaccggaggatacctgctgggagctgctatgactactcgatacgtattcgatatccacgatgatgacattctgttcaccgctggagatgtcggttggattactggtcacacttacgctttgtacggacccctgcttttgggatccacttcggtcatctttgagggtactcctgcctaccctgactacggccgatactggcagattgttgaaaagtacaaggtcacccagttctacgtggctcctactgctctgcgtctgctcaagaaggccggggtggaccacattgaaaagtacgatctgtctagtctgcgaactctgggatcagtgggtgagcccatttcccctgagctgtgggagtggtaccacaagcacgttggtcgcgaggtttgccacgtttctgacacttactggcagactgagactggatcccacattatcgctcccctgtccggtgtgatttccatgaagcccggttcggctactctgcccttctttggtatcgaccttgctatcattgaccctgtgtctggcaaggagattgagggcaacgacgtagagggagtgctggccattcgaaagccctggccttcgatggctcgctctgtgtacggtgaccacaagcgattcatggagacttacctcaagccataccccggctactactttactggagatggtgcttaccgagacaaggacggttactactggatccgtggccgtgttgacgacgttgttaacgtgtctggacaccgtctgtctacttcggagattgaggcctctctgctgggagctccttctgtttccgaggctgctgtggtcggaattgctgacgagctcaccggacaggccgtggtggctttcaccagtgtaaagggtgacgacgtttccgcagaagacgccctggctcagaagaagcgattgattatgcatgttcgtggagagattggtccctttgctgctcccaagactgtcatcattgtggacgacctgcccaagacccgatcaggcaagatcatgcgacgaattctgcgcaagattgtctccaacgaggttgattccattggagacattagcacgctcatgaaccctggatgtgtagaggacatcatcaacgccgtcaagcagcagttataa

SEQ ID NO: 13 - protein, 413 aa, Arxula adeninivorans
MSVTLTQRRPSMTAPKEEPKKALDTFGNEFVVPSYSIKDILDAIPAHCYKRSAVRSLSYVARDVFFIGLFGYLAASYIHLIPWMSGRVVAWFLYAFVQGLFGTGCWVLAHECGHRAFSESNAINDSVGWVLHSALLVPYHSWRLSHSKHHKATGHMTRDMVFVPKTRDEFLERRGVEPGTKITDNLEDAPIVTLYYVVLQQLFGWIMYLFTNVTGQKYPNRSKWVTNHFVPTSPLYDKKDFINIVISDIGIIATLTCLYLASQKWGFSTVALMYVFPYLWVNHWLVHITFLQHTDPRLPHYNADEWTFAKGASATIDRDFGFIGRHIFHDIIETHVLHHFVSRIPFYNGREATEAIRKVMGTHYQRDDSNFVTSLYRVARTCQFVEGDNGVSMFRNVNNIGVRPNLDQGQKLQ

SEQ ID NO: 14 - DNA, 1242 bp, Arxula adeninivorans
atgtctgtcacccttactcaacgtcgtccgtctatgacggctcccaaggaggagcccaagaaggccttggacacgtttggaaatgaattcgttgtgccttcgtactctatcaaggacattttggatgccattcccgctcactgctacaagcgatccgcggtgcgatctctgagctacgtggctcgggatgtcttcttcattggtctgttcggataccttgctgcttcgtacatccacctcattccctggatgtccggacgagtggttgcctggttcctgtacgctttcgtacagggtctgtttggaactggatgctgggtcttggcccacgagtgtggacaccgtgccttttctgaatccaatgctatcaatgactctgtaggatgggtccttcactccgccctgctggtcccttatcactcgtggcgtcttagtcactccaagcaccacaaggccactggacacatgacccgagacatggtgtttgtaccaaagacccgagatgagttccttgagcgccgaggagtcgagcctggcaccaagattaccgacaacctggaggatgcccccattgtgaccctgtactacgttgtgctccagcagctgtttggatggattatgtatctgttcaccaacgttacgggacaaaagtaccctaaccgatcaaagtgggtgaccaatcactttgtgcctacttctcctctgtacgacaagaaggactttatcaacattgtcatctctgacattggtatcattgctaccctgacctgtctgtaccttgcttcccagaaatggggtttctccaccgtggccctcatgtacgttttcccttacttgtgggttaaccactggctggttcacatcaccttccttcagcacactgatccccgactccctcactacaatgccgacgaatggacctttgccaagggtgccagtgctaccattgaccgagactttggattcattggccgtcacatcttccacgacattattgagactcacgttcttcaccactttgtgtcgcgaattcctttctacaatggacgagaggccaccgaggcaatcaggaaggttatgggcacgcactaccagcgcgatgactccaactttgttacttccttgtaccgtgtcgctcgaacttgtcaatttgtggaaggagacaatggtgttagcatgttccgcaatgttaacaacattggagtccggcccaatttggaccaagggcagaagcttcaatag

SEQ ID NO: 15 - protein, 388 aa, Arxula adeninivorans
MVRFAPLNVPLHRRLETFALTYHILSIPVWMSFFLLCCAIPLMWPLVIIYLLYYASDNSSENGGVASRYSPKFRSVPLWKYFANYFPITLHRTQELPPAFVYQGEDLDPETPDDSDDGHAKSKSIVLKLWKVAFWWYYLPKHFLRKPEVRPTGRRYIFGYHPHGIIGMGAIGAIATEGAGWSKLFPGIPVSLLTLANNFRIPLYREYLMSLGIASVSRRSCEALLKRGQSICIVIGGAQESLLAHPGHMDLVLKRRKGFIKLALEVGNTDLVPVMAFGENDLYQQVNSSKSSRLYKLQSLVKNALGFTLPLMHARGVFNYDVGIIPYRRPINVVVGKPIPIPHIPNPSADQVNRYQIQYMTELKELYDKYKDKCSNKDLPVPELTFVE

SEQ ID NO: 16 - DNA, 1167 bp, Arxula adeninivorans
atggttcggttcgctcctttaaatgttcctcttcatcggaggttagagacgttcgcgctcacctaccatatcctgtcgattccagtatggatgtccttctttttgctatgctgtgccattcctttaatgtggccgttggttatcatctacctgctgtactatgcttccgacaacagctctgagaatggaggggttgcgagcaggtattcgccaaagttcaggtccgtgcctctttggaagtactttgcaaactactttccaatcacccttcaccgtactcaagagctaccgcccgcattcgtgtaccaaggcgaagacttggaccctgagacgcccgatgacagtgacgacgggcatgcaaagtcaaagtctattgtattaaagctgtggaaagttgcattctggtggtactacttgcccaagcattttcttcgcaaaccagaggttcgtcctacgggtcgaagatacatctttggatatcacccccatggaatcattggcatgggtgccattggcgcaattgctactgaaggtgcggggtggtccaagctcttccccgggatccctgtcagtttgctcactctggcaaacaactttcgaatccccctgtaccgggaatatctcatgtctctgggcattgcctcggtatctagacggtcctgtgaagctttattaaaaagaggacagtcaatttgcattgtaattggaggcgctcaggaaagtcttcttgcacatccagggcacatggatttggtgctcaagcgacgcaagggattcattaaactagctcttgaagttggcaacaccgacttggtgccagttatggcatttggagaaaacgatctctaccagcaagtgaacagtagcaaatcctcccgtctatacaagctccagagcctagttaagaatgccttgggattcacgcttccgctgatgcacgctcgaggagtgttcaattatgacgtgggcataataccctatcgaagaccaattaacgttgtagtgggcaagcccatccccattccacacattccaaacccatctgccgaccaggtcaatcggtaccagatccagtacatgactgaactcaaagaattgtacgacaagtacaaagacaagtgcagtaacaaggatcttccagttccggagcttacatttgtagagtag

SEQ ID NO: 17 - protein, 515 aa, Arxula adeninivorans
MATATAIATVTEGLGLDKVLSKEQPGLSKLAPRANTNVQPTQLQSPSPPQSRSSSPISASSSSESLELKVPKAKSPSSSKHKPHYRPVHVRSTASILSRDPAARTEPPSYSGFRNLAMIALAVSNMRLLLEDYQNYGVFHTLNIMGLSAHDVRLTLALTASVPFHLFVALAIERIAVLTMPSKSTAHNHRSKHLWGLFAVLHALNAAAVLAISSYTVYSRMWSPAVGTLCECHAIVVCFKVASYALTNRDLRDAAIDGLETTDPLLSKLPYPSNLTLSNLVYFWWAPTLVYQPIYPRWPLHRRWGFIFSRLLEIMGSMVLIWFISTQYANPILESSLGHFEQFNVVKISECLLKLASVSMAIWLLGFFCLFQSFLNLLAELVRFGDREFYQDWWNAGSVGTYWRKWNRPVHNYFLRHFYIPMLKRGYSQRTASVIVFFLSAILHEVAVGVPTQSLIGVAFVGMGAQIPLVLATSPLEKMGETGATIGNCIFWLSFFLGQPMGVLLYYFAWNMKHQ

SEQ ID NO: 18 - DNA, 1548 bp, Arxula adeninivorans
atggccaccgctactgctatcgctacggtcacggagggcctgggactagataaggtgctatccaaggagcagccaggcttgtcgaagctagctcctcgagcgaatacaaatgtacaaccgacccagttgcagtccccgtctccaccacaatctcgatcttcgtctccaatttcggcctcctcatcatcagagtccctggagctcaaggtgcccaaggccaaatcgccatcatcttccaaacacaaaccacactaccgccccgtgcatgtgcggtcaacagcatccatcctgtccagagacccggccgccagaaccgagcctccctcttactctgggttcaggaacctagccatgattgcattggcggtttctaatatgcgcctccttctcgaggactatcaaaactatggcgtgttccacactctcaacattatgggcttgagcgcacacgacgttcgcctcacactggcattgacagcttcggttccgttccatctgtttgtggccctggccattgagcgcatcgcagtcctcactatgccctccaaatctacagcacacaaccaccgctcaaagcatctctggggcttgtttgcagttctgcatgctctcaacgccgctgctgtgctagcaatcagctcatacaccgtatacagtcgcatgtggagtcctgctgtgggaacattgtgcgaatgccacgcaatcgtggtatgctttaaggtggcatcgtatgcgcttaccaaccgagacttacgagatgctgccattgatgggctagagacaactgaccctctgttgtccaagttgccctacccatccaaccttaccttgtcaaatctcgtgtatttctggtgggccccaaccctagtgtatcagccaatttaccctcgatggcccctgcatcgacgatggggcttcatcttttctcgcctgctcgagattatgggatctatggtactaatctggttcatttccacccaatacgccaaccccattttggaatcatccttggggcactttgaacagtttaacgtggttaaaatctcagaatgtctcctcaaattagcatcggtctccatggccatctggcttttgggtttcttttgtctctttcaatcgtttttgaacttgctggcagaattggttcgttttggcgaccgcgagttctaccaagactggtggaacgccggctcagtaggtacctactggcgcaaatggaaccgaccagtgcacaactatttcttgcgccatttctacatcccaatgctcaagcgaggttattcacagcgcactgcctcggtcattgtattctttttatctgccattctccatgaagttgctgttggcgtgcctactcagtccttgattggagttgcgtttgtaggcatgggtgcccagattcctctagtgctggccactagtcctttggaaaagatgggcgaaactggcgcaactattggcaactgcatcttttggctctctttcttcctgggccagccaatgggggtactgctttactactttgcgtggaatatgaagcaccagtag

SEQ ID NO: 19 - protein, 363 aa, Arxula adeninivorans
MSRTIHPLVAVWRDWALATYPIEINLLKMVKVGINGFGRIGRLVLRNAIANPEVEVVAVNDPFIAVDYAAYMFKYDSTHGRFKGEVSHTDDSLVVNGKNIKVFNEKDPAAIQWGSVGADYVVESTGVFTEQAKAEAHLKGGAKKVVISAPSKDAPMFVMGVNNQEYKSDLKVISNASCTTNCLAPLAKVIHDKYGIVEGLMTTVHSLTATQKTVDGPSHKDWRGGRTASGNIIPSSTGAAKAVGKVIPSLNGKLTGMSLRVPTTDVSVVDLTARLEKGAAYDEIKKTVKEAAEGPLKGILGYTEDDVVSTDFLGDTHSSIFDAKAGILLNENFVKLISWYDNEYGYSARVVDLLVYIAKQDGN

SEQ ID NO: 20 - DNA, 1739 bp, Arxula adeninivorans
atgtccagaaccatccatccgttggttgcggtgtggcgtgactgggccctggccacataccgtgttccttagtcagtttcagccttgaagagtggtggtgcggcgcgccatcaaggaaccaatgaacaactgtcccaagcgtaatcttttgttgggtcgcataatgggctagtgaaggacacagtggcaattgcaaccagcggtgaggggtatttgagctcgaccagcgctcgctcggttatgacgatgatagttcccgtgccattttcgtcaaaataatcgtcgccgttgtccgacgaaaatggcaatgcccttacctccatacattattagcgcgctttgttccgggccattaccgtatgcataatacgagaatttcaaaccctttctcatgtgcaattatcgttcgggtgcctacaagtgcctggccaggcatccccagatagtgggaaccgtagatacaagaaccgccctattttagctcaactcgtacaattgtaaattgaaatgcaacataatggaaccgtgtggaatcggccaattgtcacccattcgcacccatggtgacgcctactcgggaggtgcggaacaagggaaaagtgaccaagaaggggcctggcgcggctgaaccgacccaacaaatacaaatatatataggacccccttgtccccgagcctagagttgctgtgtgtttaacaaaactaaagcaattgaaattaacttgttaaaaatggtcaaggttggaattaacggattcggtcgtatcggacgtcttgtcctgcgaaacgccatcgccaaccccgaggttgaggttgtggctgtcaatgatcctttcattgctgtcgactacgctgcctacatgttcaagtacgactccacccacggacgtttcaagggtgaggtttcccacactgatgacagccttgtggtcaatggcaagaacatcaaggtgttcaacgagaaggaccccgccgccatccagtggggatccgtgggcgctgactacgttgtcgagtccactggtgtcttcaccgagcaggccaaggctgaggcccatctgaagggaggtgccaagaaggttgtcatctctgctccttccaaggacgcccccatgttcgttatgggagtcaacaaccaggagtacaagtctgacctcaaggtcatctccaacgcttcttgcaccactaactgtctggctcctctggccaaggttatccacgacaagtacggtattgtcgagggtctcatgaccaccgtccactccctgaccgccacccagaagactgttgacggtccttctcacaaggactggcgtggaggacgaactgcctctggcaacatcattccttcctccactggtgccgccaaggctgtcggtaaggtcattccttctctgaacggaaagctcaccggtatgtctctgcgtgtccctaccaccgatgtgtccgttgttgacctgactgcccgtctggagaagggtgccgcttacgacgagatcaagaagaccgtcaaggaggccgctgagggtcccctcaagggaatcctgggatacactgaggacgatgtggtgtccactgacttcctcggtgacactcactcctccatcttcgacgccaaggctggtatcctgctgaacgagaactttgtcaagctcatctcgtggtacgacaacgagtacggatactctgcccgtgttgttgaccttctggtctacattgccaagcaggacggcaactaa

SEQ ID NO: 21 - protein, 363 aa, Arxula adeninivorans; identical to SEQ ID NO: 19

SEQ ID NO: 22 - DNA, 1092 bp, Arxula adeninivorans
atgtccagaaccatccatccgttggttgcggtgtggcgtgactgggccctggccacatacccaattgaaattaacttgttaaaaatggtcaaggttggaattaacggattcggtcgtatcggacgtcttgtcctgcgaaacgccatcgccaaccccgaggttgaggttgtggctgtcaatgatcctttcattgctgtcgactacgctgcctacatgttcaagtacgactccacccacggacgtttcaagggtgaggtttcccacactgatgacagccttgtggtcaatggcaagaacatcaaggtgttcaacgagaaggaccccgccgccatccagtggggatccgtgggcgctgactacgttgtcgagtccactggtgtcttcaccgagcaggccaaggctgaggcccatctgaagggaggtgccaagaaggttgtcatctctgctccttccaaggacgcccccatgttcgttatgggagtcaacaaccaggagtacaagtctgacctcaaggtcatctccaacgcttcttgcaccactaactgtctggctcctctggccaaggttatccacgacaagtacggtattgtcgagggtctcatgaccaccgtccactccctgaccgccacccagaagactgttgacggtccttctcacaaggactggcgtggaggacgaactgcctctggcaacatcattccttcctccactggtgccgccaaggctgtcggtaaggtcattccttctctgaacggaaagctcaccggtatgtctctgcgtgtccctaccaccgatgtgtccgttgttgacctgactgcccgtctggagaagggtgccgcttacgacgagatcaagaagaccgtcaaggaggccgctgagggtcccctcaagggaatcctgggatacactgaggacgatgtggtgtccactgacttcctcggtgacactcactcctccatcttcgacgccaaggctggtatcctgctgaacgagaactttgtcaagctcatctcgtggtacgacaacgagtacggatactctgcccgtgttgttgaccttctggtctacattgccaagcaggacggcaactaa

SEQ ID NO: 23 - protein, 574 aa, Arxula adeninivorans
MGKFNHLPLAFKRKVKVPYVGLPLLNTPFYNKGSAFGAEERQALNLRGLVPPSYQTLKEQEKRAYEQYRELPTPLLRNAFMASMSEQNTVLYYKLIEEHIKEMSSVIYTPTQGDAIQQYSKIFRRPTGCFLPITRPEQIEERLGRFVRPNSPEDGGIDYIVVTDGEAILGIGDQGVGGILICSAKLALTTACAGIHPDRVLPVVLDVGTDNQELRVDELYLGLQQRRTRGKEYDEFVGKFVQAVRKLFPRAFLHFEDFGVYNARRLLDKYRDQFAVFNDDIQGTGCVTQSCVMAAASVSGLKLGDLRVLVYGSGSAGTGIADQIAKGIAADRGISREEAHKQIFCMDRQGLLLDNMGDDLSLAQLPFAKPAGEWEGKDTKCLKTMIHEIKPHVLLGTSTRPGSFTKEIVQEMARHVERPIIFPLSNPTRLHEAIPQDLYNWTDGKALVATGSPFDPVEHNGKVLEPAECNNVVCFPGIGLGCVLGRVKLLTDEMLDEAVRALASEAPALKDDTKSLCIDVTQVKPVSVKIAAAIIKEARKSDLLGVEGVPEDDTELAEWIEAQMWRPEYRELVA

SEQ ID NO: 24 - DNA, 1725 bp, Arxula adeninivorans
atgggaaagttcaaccatttgcctttggcgtttaagcggaaggttaaagtcccctatgttggtctgccgctgcttaatactccattctacaacaaaggtagcgcgtttggtgcggaggaacgacaggctctgaacctaagggggttagttcctcctagctaccagacattgaaagagcaagagaagcgtgcttatgagcaataccgtgaattgccaacgccgctgttgagaaacgcgttcatggcttcgatgtcggaacaaaacactgtactgtattacaagctaattgaggagcacatcaaagaaatgtctagtgttatctacacaccgacccagggagatgcaattcaacaatactcgaagatattccgccgtccaacagggtgctttttgcctattacccgcccagaacagatagaagagagattgggccgttttgtcaggcctaatagtcctgaggatggaggaattgattatatcgttgtaactgacggagaagcaattctaggaattggtgatcaaggagtgggaggcattctcatctgcagcgccaaattggctttgacaactgcttgtgcaggtatccatcctgatcgggtgctcccggtagtgcttgatgtgggaacagataaccaagaattgagagtagacgaactttaccttgggttacaacaaagaaggacacgaggtaaggagtacgatgaattcgtgggcaagttcgttcaggctgttcgcaaactcttccccagggccttcctccactttgaagatttcggagtatacaatgcccgacggcttttggacaagtatcgcgatcagtttgctgtgttcaatgacgatattcagggcactggatgtgtaacacagtcctgcgttatggctgccgcaagcgtgagtggacttaagcttggcgatcttagggtgctggtatacggtagtggtagcgctggaactggaattgccgaccaaatcgccaaggggattgccgctgacaggggaatttcaagggaggaagcacacaaacagattttctgtatggatcgccagggtcttttgcttgacaacatgggcgacgatttgagcttggctcaattgccttttgccaaaccggcaggggaatgggaaggcaaggatacaaagtgcttgaagactatgatccatgagatcaagcctcatgtactgctaggaacgtccaccagacctggaagctttacaaaggaaatagtgcaggagatggcccgtcatgtcgagcggcctattattttccccttgagtaaccctactaggctgcacgaagcgattcctcaagacctttacaactggaccgatggtaaggctttggtagcaacggggtccccatttgatccagtggagcacaatgggaaggtacttgaaccagcagaatgtaataatgttgtctgtttccctggaattggcttaggatgtgtattgggacgggttaaattgttgaccgatgagatgctggatgaagcagttagagctctagcaagtgaggcgcctgctctgaaagatgacacaaagtctttgtgcatcgatgtgacgcaagtaaagcctgtgagtgtcaaaatagcagctgcaattatcaaggaagcacggaaaagtgatctcctgggagtagagggagtgccagaagatgatactgagctagcggaatggatcgaggctcaaatgtggaggccagagtaccgcgaactggtcgcatag

SEQ ID NO: 25 - protein, 887 aa, Arxula adeninivorans
MSELRYDGKVVIITGAGGGLGKQYALYYGSRGASVVVNDLGGSLKGGDGNTRVAEQVVKEIEGLGGKAVPDFNSVENGEKIVETAVKAFGTVHIVINNAGILRDVSFKNQKPEDWELVYKVHLYGAYKVTKAAWPYMRKQKFGRVINTASAAGLYGNFGQTNYSAAKLALVGFTETLAKEGQKYNITANVIVPLAASRMTETIMPPDMLEKLKPEFVVPVVGYLTHEDTTETWGIYETAAGAVTKVRWERAKGALVKPDSSWTPSAALKRFEEIEDFSSGSSFPNGSADFMSLVDAAQKQSSNPQGEDISFKDQVVIVTGGGNGLGRAYSLLLAKLGAKVVVNDFADPEPVVQEIKKAGGIAVGDKHNVVEGDKVVQTAVDNFGTVHAIINNAGIIRDKSFANMTDELWDSVIAVHLTGTYAVTKAAWPYFLKQKYGRVVNTTSTSGIYGNFGQANYAAAKLGILGFGRALALEGKKYNIFVNTIAPNAGTQMTQGVFTEEMLELFKPEFVAPVPVLLASEKSPVTGHLYEVGSGWAGRTRWQRSGGYAFPNSKPLTPEAIKAKWDKIVDFDDGRATNPETTQESSIGLFELMANAEEGDSEGDSEGGDGEVGVFSYTNRDVILYNLGVGATAKDLDYVYENREDFRPVPSFGVLPYFTCPVDYSSIVKNFNPMTLLHGEQYLEVLKYPIPTEGTLETTSEVLDVVDKGKAAVVTAGFTTKIKETGEPLFYNVSSIFLRGSGGFGGPTKGKDRGAITAANKPPSRDPDFVTEFKVSPDQAALYRLSGDYNPLHIDPDFAAVGNFPQPILHGLCSMGISARVLTDKFGTFKNIKVRFSGHVFPGETLKVTAWKEDNKVIFETYVVERGTKAISAAALELLPKNGGAKL

SEQ ID NO: 26 - DNA, 2664 bp, Arxula adeninivorans
atgtctgaattgcgatacgacggaaaagtcgtgatcatcactggagccggtggtggtctcggaaagcagtacgccttgtactacggatccagaggagcatctgtagttgtcaatgacctgggaggatctctcaagggaggtgacggcaacacccgagtagcagagcaggtggtcaaggagattgagggtctgggcggaaaggccgtgcccgatttcaactctgtggagaacggtgaaaagattgtcgagaccgccgtcaaggcgttcggcaccgtccacattgtcattaacaacgcaggaattctgcgagatgtgtcgttcaagaaccagaagcccgaggactgggagctggtgtacaaggtccatctttacggagcatacaaggtcacaaaggccgcctggccctacatgcgcaagcagaagtttggtcgagtgatcaacactgcctctgctgccggactgtacggaaactttggtcagactaactactctgccgccaagctggccctggtcggtttcacagagacccttgctaaggagggacagaagtacaacattactgccaatgtcattgtacccctggccgcatcgcgaatgaccgagaccattatgcctcccgatatgctcgagaagctcaagcctgagtttgttgtccccgtggttggatacctgacccacgaggacaccaccgagacctggggtatttacgaaactgccgctggtgctgtgaccaaggtccgatgggagcgagccaagggtgctctggtgaagcccgactcctcttggactccctcggccgctctcaagcgtttcgaagagattgaggacttcagctccggatcttcgttccccaatggatcggccgactttatgtccctggttgatgctgcccagaagcagtcctccaacccccagggcgaggacatttctttcaaggaccaggttgtcattgtcaccggaggaggcaacggtcttggacgcgcctactcgctgctgctggctaagctgggtgccaaggttgtagtcaacgactttgctgaccccgagcctgttgtgcaggagattaagaaggctggtggaatcgccgtcggcgacaagcacaacgtcgtggagggtgacaaggttgtccagactgccgtcgacaacttcggcaccgtgcacgctatcatcaacaatgctggaatcattcgagacaagtcgtttgccaacatgaccgatgagctgtgggactctgtcattgctgtgcacctcactggtacctacgccgtcaccaaggccgcctggccctacttcctcaagcagaagtacggacgagtggtcaacaccacctccacttctggaatctacggaaactttggacaggccaactatgccgctgccaagctgggaattctcggtttcggacgtgctctggccctggagggaaagaagtacaacattttcgtcaacaccattgcccccaacgctggtacccagatgacccagggtgtgttcaccgaggagatgcttgagctgttcaagcccgagtttgtcgctcccgttcccgtgctgctggcctccgagaagtcccctgtcaccggtcacctctacgaggttggatctggctgggctggacgaacccgatggcagcgatctggcggttacgccttccccaactccaagcctctcactcccgaggccatcaaggccaagtgggacaagattgtcgactttgacgacggacgtgccactaaccccgagaccacccaggagtcttccattggcctgtttgagctcatggctaacgctgaggagggcgattccgagggtgactccgagggaggcgacggcgaggtcggtgtcttctcctacactaaccgcgatgtcattctgtacaacctgggagtgggtgccactgccaaggacctcgactacgtgtacgagaaccgggaggacttccgacccgtgccttcgttcggagtgcttccttacttcacctgccccgttgactacagctccattgtaaagaacttcaaccccatgactctgctgcacggagagcagtacctggaggttctcaagtaccccatccccaccgagggcactctggagactaccagtgaggttctggatgtggttgacaagggcaaggccgctgttgtcactgccggattcaccaccaagatcaaggagactggcgagcctctgttctacaacgtttcttccatcttccttcgtggatctggaggattcggaggtcctaccaagggtaaggaccgaggtgccatcactgccgccaacaagcctccttcccgagaccctgactttgtcaccgagttcaaggtgtctcctgaccaggctgctctttaccgtctgtcgggagactacaaccctctgcacattgaccccgactttgctgctgtgggcaacttccctcagccaattcttcacggactgtgctccatgggtatcagcgcccgtgtgctgaccgacaagttcggtactttcaagaacattaaggttcgattctcgggccatgtgttccctggtgagacccttaaggttaccgcctggaaggaggataacaaggttatcttcgagacctacgttgtcgagcggggtacaaaggccatctctgctgccgccttggagcttctgcccaagaacggaggagccaagctttaa

SEQ ID NO: 27 - protein, 486 aa, Arxula adeninivorans
MNGPEEVNLEEVQAIASGAEVRAKVNINRRRQEEQAAAAAASSGSTKTHISEQAFTLANWHKHFNWINTTIIAIIPAIGFLSVPFIPVHGKTLAWAFVYYFLTGLGITAGYHRLWAHRAYSASWPLRVFLALLGAGAGEGSVKWWSNGHRTHHRYTDTDKDPYNAKRGFWFSHMGWMMFKQNPKLKGRCDISDLICDPIIRWQHRHYIWIMAAMSFVFPSVVAGLGWGDYLGGFVFAGILRQFVVHQSTFCVNSLAHWLGEQPFDDNRSPRDHVLTAFATLGEGYHNFHHEFPSDYRNAIKWYQYDPTKIFIWTMKQLGLASNLQTFSQNAIEQGLVQQKQKKLDRWRARLNWGVPIEQLPVIEYDDFKDESSSRSLVLISGIVHDVTDFIDKHPGGKALIKSAIGKDGTAVFNGGVYKHSNAAHNLLATMRVAVIRGGMEVEVWKRAQGEKKDVDPVADSAGDRILRAGDQPSRVPEARVSGRAA

SEQ ID NO: 28 - DNA, 1461 bp, Arxula adeninivorans
atgaacggtcccgaagaggtgaatctcgaagaagtccaggccattgcgtctggagccgaagttcgagctaaggtcaacatcaaccgacgaaggcaagaggagcaggctgccgccgctgctgcctccagcggttcgacaaagactcatatctccgagcaggctttcaccctcgccaactggcacaagcatttcaattggatcaacacaaccatcattgccattatcccagcaatcggctttttgtcggtgcctttcattcctgtgcacggcaagacattagcgtgggcattcgtctactactttttgaccggtctgggaatcaccgccggataccaccgtctgtgggctcaccgggcttacagtgcatcatggcccctgcgagtgttcttggcacttttgggtgctggagccggtgagggttcagtaaagtggtggtctaatggacaccgcactcaccaccgttacactgacactgacaaggatccttacaatgccaagcgaggattctggttctcccacatgggctggatgatgttcaagcagaaccccaagctcaagggacgatgcgacatttccgatcttatctgcgaccctattattcgatggcagcaccgacactacatttggatcatggcagcaatgtcgtttgtattcccttctgtagttgctggactgggctggggagactacctgggaggatttgtgtttgcaggaatcctgcgacagtttgttgtccaccagtcgaccttctgtgtcaactcgcttgcccactggctgggagagcagccttttgacgacaaccgatctcctcgagaccacgttctgactgcgtttgctactctgggtgagggttaccacaacttccaccacgagttcccctccgactaccgtaacgctatcaagtggtaccagtacgaccctaccaagatcttcatctggaccatgaagcagcttggtctggcctctaacctgcagactttctcccagaatgctattgagcagggtctggtacagcagaagcagaagaagctggaccgatggagagctcgtctcaactggggagtgcctattgagcagcttcctgtaattgagtacgacgacttcaaggacgagtcatcttcccgatctttggtcctcatttctggaattgtccacgatgttaccgactttattgacaagcaccctggtggaaaggctctcatcaagagcgccattggcaaggacggaactgccgtgttcaacggaggtgtgtacaagcactccaacgctgctcacaacctgctggccactatgcgtgtagctgtcattcgaggaggaatggaagtcgaggtctggaagcgtgcccagggcgagaagaaggatgttgaccctgtcgccgattccgctggtgaccgtatcctgcgagctggcgaccagccttctcgtgttcctgaggcccgtgtctctggccgcgctgcttaa

SEQ ID NO: 29 - protein, 579 aa, Arxula adeninivorans
MIRAAYGSVSRARDSLTLRAPSFPTTAVEVRDKILWILYAWIEMFTDVFSFWTEKVWGYVSTPTKESILRKQLDEAKSYHEWEELSYKLDSILGNDIWRQNPVSRKYDYRLISTRLKELVAARDNRNIELLMDRLRSGLLRNIGSIASTHLYNRAYSGTKLLIEDYINVVIQCLEYVERGGRPLTASASKIPNGGEPPSPRTYHKPMITRQRKLNFFNDTRQSFGSTAVVLHGGSLFGLCHIGMIKTLFNQGLLPRIVCGSTVGALVASLVCSCVDEEVYETLDNVSSEMSPLRQGYTDIKYHSVAEGVISSMCPPEILIFEQYIREKLGDLTFEEAYQRTGRILNIPVTPKAKPGQVAPPVPTLLNYLSSPNVVVWSAAQCSIGTGIIHKKVELLVKGLDGQLKPYLDADDIEYTPANQAVYAADRESPYTRLSELFNVNNYIVSVARPYFAPILLSDFKYRAAKSFKTRFLKLTRLELQYRLNQLSQLGLVPPMIQQWFVDGNIPAGFQVTVVPELPSLIRDIGKVFDSDNIKEKVDYWIKIGERSVWPVLNIIWARCAIEFVLDDLYHSRRKDELD

SEQ ID NO: 30 - DNA, 1740 bp, Arxula adeninivorans
atgattagggctgcctacgggtcagtgtccagggcccgagattctttaacgttgagggctccatcttttcctaccactgctgtggaggtccgtgacaagattctatggattctgtatgcctggattgaaatgttcacggacgtctttagcttctggacggagaaggtgtggggttatgtttctactcctactaaagaaagcattcttagaaagcaactcgacgaggcaaaatcataccatgaatgggaggagctcagctacaaactagactcaattttagggaacgatatttggcgacagaaccctgttagccgaaagtatgactatcgcctgatttctacccgcctcaaggaattggttgctgctagggataatcgcaacattgaattgctaatggatcggctaaggtcaggcctgcttcgtaatattggatcgattgcaagtactcatctctacaaccgagcgtattcgggcacaaaactgttaattgaggattacattaatgtagtgattcaatgcctggagtatgttgaacggggcggcaggccattgactgcttcagcatccaagattcccaatggcggtgaacccccttctccacgaacctaccataagcccatgattaccagacagcgcaagctcaacttcttcaatgatacacgccagtcgtttggaagtacagctgtggtacttcacggcgggtccttgtttggactttgccatattggcatgattaaaacattgttcaaccagggtctacttcctcgcatagtctgtggctccacagtgggagcactagtagcgagtctagtatgctcctgtgtggatgaagaggtgtatgagactttggataatgtgtcttcggaaatgtctcctctccgccaaggatacactgatataaagtaccattcggtagccgaaggggtcatttcatcaatgtgtccgccagagattttgatttttgaacagtacatccgagaaaaactcggagacctgacatttgaagaagcatatcaacgcaccggccgcattcttaatatcccagtgacaccaaaggcaaaaccaggtcaggtagcaccaccagtcccgacgctcctgaattatttgtcgagcccgaatgttgtagtatggtcagcagcgcaatgcagcattggaacggggattattcacaagaaggttgaacttttagtaaaaggtctggatggtcaattaaaaccttatttggatgcggatgatattgaatacactcctgcaaatcaagctgtatacgctgctgatcgcgagagtccctatacaagattgtctgagctgttcaatgtgaacaattacattgtatcagtagctcgcccctactttgccccaattctgctttcggatttcaagtaccgtgcagctaaaagcttcaagacccggttcctcaaactaacccgtctggagttacagtatcgtctcaatcagctgtctcaattggggctggttccgcccatgattcaacaatggtttgtggacggtaacattcccgccgggttccaagttaccgtggtgcctgaattaccctcacttattagagacatcggcaaggttttcgattcggataatataaaggagaaggtcgactactggattaagatcggtgagcgcagtgtgtggccagtgctgaatattatctgggcaaggtgcgcaattgagtttgtgctcgacgatctatatcacagccgacgtaaagacgaactcgactag

SEQ ID NO: 31 - protein, 633 aa, Arxula adeninivorans
MNPFDVDYTNRDHLVDFERALHEDEASHIISVNDWAPVHAPLKRRLRRKPTDSDPGTGLGYTLLRWPILVAIALWLALLAFVYAIVRFWVALFEYFVTWRGPRRNLREKLRSARSYEEWISAAKVLDDHLGNTSWKHNPKFSRYDYRTIDRITNSLRQLRNQNKAEEVGSILQGCVKHNFAGTQGQPLYSQCYYGTKDLVEEFNSEIVKSLDYLATHPDLSPQSRRLLFKMFSKNFGKTALCLSGGATFAYRHFGVVKALLEQGLLPNIISGTSGGGLVAALVGTRTNSELRELLTPQLADKITACWEKFPKWVYRFYSTGARFDAVDWAERSCWFTLGSLTFREAYDRTGKILNISTVPADPNSPSILCNYITSPDCVIWSALLASAAVPGILNPVVLMMKTKKGNLVPYSFGNKWKDGSLRTDIPVHALNVYFNVNFTIVSQVNPHISLFMYAPRGTVGRPVSHRQGKGWRGGFLGSALEDMLKLEIRKWLKLMKNLSLMPRFFNQDWSSVWLQTFEGSVTLWPRIRLKDFYYILSDPTREQMETMIISGQRCTFPKLLFIKHQVNIERAIDRGRKHNAKAREENGPQLRRVNPFLHDLDDRVYHSSSSVDPREFQDDHDDEDDDSTDSSM

SEQ ID NO: 32 - DNA, 1902 bp, Arxula adeninivorans
atgaacccgtttgatgtagattacacaaacagggaccatctggtcgactttgaacgagctttgcacgaagatgaggcttcccatattatatcggtaaacgactgggctccagtgcatgctcctctcaagcgacggttgagacgcaagccgacagattcggatcctgggacaggattaggatacactttgcttagatggcctattctggtggcaattgcgctgtggctggccctgttagcatttgtgtacgccatagtgaggttttgggtcgctctgtttgagtactttgttacctggcgaggaccccggcgcaatcttcgtgaaaagctacgcagcgctcgtagttacgaggaatggattagtgctgccaaagttcttgatgaccatctaggaaatacttcttggaagcacaacccaaagttctctcgatacgactaccgtactattgatcgcatcactaactcactgcggcaactgcgaaaccagaacaaggccgaggaggttggctctattctacaaggatgcgtcaagcacaactttgctggaactcagggccaacctttgtactctcagtgctactatggcacaaaggacctggtagaggagttcaattctgaaattgtgaaatcgctcgattacctggcaacccatccagacctgagtcctcaatctagacgtcttttgttcaaaatgttttccaagaattttggaaagacggcattgtgcctctctggaggggcaacatttgcctatagacatttcggagttgttaaagcgctcttggaacagggcttgctgcctaatattatttctggtacttctggcggaggattggtagctgcgctagttggtaccagaacaaatagtgaactccgtgagcttctcactcctcaactggccgacaagatcaccgcctgctgggaaaagttcccaaaatgggtttatagattctacagcaccggcgctcgattcgatgccgtcgactgggctgaacggtcttgctggtttacactaggaagcctgacttttagagaggcctacgatcgaactggaaagatcctcaacatttccactgttcctgctgaccctaattccccttcaatcctctgcaattacattacttctcccgactgtgtcatctggtcggctttacttgcttctgctgcagtaccgggaattctgaacccagtggtgctcatgatgaagacgaaaaagggcaatctggtaccttacagctttggtaacaagtggaaggatggttctctccgaactgatattcctgtccacgcactcaacgtgtactttaacgtcaacttcaccatcgtgtcccaggtcaaccctcacatttctctgttcatgtatgccccgcggggaactgtgggtaggccagtatctcaccgtcagggtaaaggctggcgaggtgggttcctaggctcagctttggaagacatgctgaagctggaaattcgtaaatggctcaaactcatgaaaaaccttagtcttatgccacggtttttcaatcaagattggtcttcagtatggcttcaaacgttcgagggatccgtcaccttgtggccaaggatcaggctaaaggacttttattatattctgtctgatcccactcgggaacaaatggaaaccatgatcattagtggacagcgatgcacattcccaaagctcttgttcatcaagcaccaagtcaacatagagcgggcaattgaccgtggaagaaagcacaatgcaaaagccagggaggaaaatggtccccagcttagacgggtaaacccattcctgcacgacttggatgaccgtgtataccattccagctctagcgtggaccctcgcgagtttcaggatgatcacgatgatgaagacgacgacagcactgattctagcatgtaa

SEQ ID NO: 33 - protein, 662 aa, Arxula adeninivorans
MQSLDLLDDRSWVPNYARVGLKSLKEYLVSHRYQSEEARKHAEALERWTKSQAQAETYEQWLFASEQLDKLSGNDKWKEDPVSPYYDSVLVQQRLQQLRDARVNSNMDELLYLVRTSLQRNLGNMGDPRLYVRTHTGSKTLIEQYIAEVELALDTLLSCGPGTFSPKVLLSNLIQTRKAFGRTALVLSGGSTFGILHIGVMRELHRAHLLPQVISGSSAGSIFASMLCIHLEDEIEELLQLPLHKESFEIFEPAGEREGLMVRLARFLKHGTWFDNKYLSTTMRELLGDLTFQEAYYRTQRILNVTVSPSSMHEMPKILNYLTAPNVLIWSAVCASCSVPFVFDSHDILAKNPRTGEFYSWNASTFIDGSVYNDLPLSRLAEMFNVNHFIACQVNPHVVPFVKFAETMSLVEARPTTTEPGSLTKLWHSTQLALSSEISHYLDLAAEMGLFKNISSKLRSVLDQQYSGDITILPELYLSEFGQIFKNPSKEFFQKAELRAARATWPKMSHIHNRVAIELALVKAIHKLRARIVSQSVHEPGSSLQVHAANDEGTLAPIRRRHSSTKLHHRRQRSDGMAVKYLVRRHSLQYFGTEGPGPAALSRKKSSAGLTQAHTPTPSLTNSVSVGGSPRHRRFTTSSRQSSGDHLEMFSQNHPLERISTG

SEQ ID NO: 34 - DNA, 1989 bp, Arxula adeninivorans
atgcaatccctggacctattagacgacaggtcctgggtccccaattatgcgcgtgtgggcctgaaatcgctaaaagaatacttggttagccatagatatcagtctgaagaagctcgaaagcatgccgaagcgttagaaagatggacaaagtctcaggctcaggcggagacatacgaacagtggctatttgcttcggagcagctcgacaagctgtctgggaacgacaagtggaaagaggacccggtgtccccatattatgacagtgtgctagtacaacagcggttacagcagctccgagatgctagggtgaatagtaacatggacgagctgctgtatttggtccgcactagcttgcaaagaaacttgggtaacatgggtgatcctcgactatacgtgaggacccatactggctctaagacgctcattgaacaatatattgctgaggtagaactggcattagacactctgctgagctgcggaccggggacgttttcacccaaagttctgttatccaatcttattcagacaagaaaggcgtttggacgaacagccctggtgctttctggaggtagtacgtttggaattttacatattggtgtaatgcgagagcttcaccgagcccatctgttaccgcaggtcatttctggatcgtcggccggatccatctttgcgtccatgctatgtattcacttagaagacgagattgaagaactactgcaactgcctctacacaaggaaagctttgaaatcttcgaacctgctggagaacgagaaggactaatggttcggctggcacggttcctcaaacatggcacttggttcgacaacaagtatcttagcacaactatgcgagagcttctaggagacctcactttccaggaggcctactaccgaacgcagcgaattctaaatgtcactgtgtctccttcgagtatgcacgaaatgccgaagattctcaactatctgaccgctcctaacgtgctcatttggtcggcagtgtgtgcatcgtgctcagtaccatttgtgtttgattctcacgacattctggcaaaaaaccctcgaactggggagttttattcatggaacgcttctactttcatcgacgggagtgtgtataatgatctgccattgtctcgactagcggaaatgtttaacgtgaaccattttattgcgtgccaggtaaacccgcatgtggttccattcgtcaaatttgccgagacaatgtcattggtggaagctcgtcccactactactgaaccgggatcgttgacaaagctatggcacagtactcagctcgcgctttctagtgagatctcacactatctggatttggctgctgaaatgggcttgttcaagaacattagttccaagctgcgatcggtgctagatcaacaatattccggcgacattactattcttcccgaattatacctgtctgagtttggtcagattttcaaaaacccatcaaaggagttcttccagaaggcagagcttcgagctgccagagcgacatggcccaagatgtcccacattcacaaccgtgtggccatcgagttggctttagtaaaggcaattcacaagcttcgtgcccgtattgtatctcagagcgtccatgagcctggcagttctctacaagtacatgctgctaatgacgaaggcaccctagcacctattcgccgtcgccattcttcgaccaagcttcaccatagacgacaacggtccgatggaatggccgtgaaatacttggtccgcagacattcgctacagtactttggcactgagggccctggtcccgctgcgctatctcgtaaaaagagttcggccgggcttacccaggctcatactcctacgccttcactgaccaacagcgttagtgtagggggcagtccaaggcaccgtcgcttcactactagctctagacagtcctcaggagaccatttggaaatgttctctcaaaatcatccgctagaacgtatctctaccggctga

SEQ ID NO: 35 - protein, 281 aa, Arxula adeninivorans
MATVVKQLVQYLPKAVAGTVVLGYFGIIKPLQFYVRLAVYILAVAFCAFNGAVLSAVLTLIGKQGLSQWCVARMFLYIAGTILGIKVVIKNPERLKTRPAVFISNHQSELDILILGATFPQYCSVTAKKSLKYYPFLGWFMALSGSVFIDRANRDNALKAFEGAAKKVNRDKQSVFMFPEGTRSYYQEPGLLPFKKGAFHFAVQAGVPIVPFVVSNYSKVVNFKKRIFEPGVIEIEVLEPIKVTGKETKEEINQLVEGTRERMLESTQRLGYGSEYNKKSN

SEQ ID NO: 36 - DNA, 846 bp, Arxula adeninivorans
atggcgacggttgtaaagcagctggttcagtatctgccaaaggccgtggcaggaacggttgttctaggctattttggcattatcaagcccctacagttttacgtgcggttggcggtttacattctggcggttgccttttgcgcgttcaatggagcggtgctgtctgcggtgctgactttgattggaaagcagggtctttcgcaatggtgtgtggccagaatgttcctgtacattgcgggaacgattctgggaatcaaggttgtgattaagaaccccgagcgtctcaagacccgacctgcggtgttcatctccaaccaccagtccgagctggacattctcatcttgggagctactttccctcagtactgtagtgtgacggcaaagaagagtctcaagtactacccgttcttgggatggttcatggctctgagtggatcggtgtttattgaccgagccaatcgagacaatgctctcaaggcttttgagggagcggccaagaaggtgaaccgtgacaagcagagcgtgttcatgttccccgagggcactcgatcgtactaccaggagcccggtctattgccatttaagaagggagcgttccactttgccgtccaggctggtgttcccattgtgccatttgtagtgagcaactactccaaggtggtgaactttaagaagcgaattttcgagcctggtgtgattgaaattgaggtgttggagcccatcaaggtcactggaaaggagaccaaggaggagattaaccaattggtcgaaggtactagggagcgcatgctggagagcacccagcgattgggctatggctctgagtacaacaagaagagcaactaa

SEQ ID NO: 37 - protein, 687 aa, Arxula adeninivorans
MAVKRRSNLPQQEVDSDSSSDSSSVSSSAASSSVDLATGSSSQIEDRFPKKTASATKRSSHHRKSKKDGGHLSYKWRLAYSKRLVFIIGIIFGLGIAWYSAPKEFVSLDRLSELSLDGLLDEFRDMLPKGIMREAHDIDKKSYTLSDSFAVGNYLREEGYGVKHPVILIPGVISTGLESWGLEGTEECPSQPHFRKRLWGSLYMLRTMLLDKHCWLKHIMLDPSTGLDPPGYKIRAALGMESADFFVPGYWLWNKILENLAAMGYDSNNMLVASYDWRLSYPDLERRDSYFSRLKSAIEHSVHSTGEKVALVGHSMGTQVIFYFLKWAEAKGYGDGGDQWVNDHIASLVDISGSTLGTPKAIVALLSGEMKDTVQLNALAVYGLEKFFSRRERADMLRSFGGIASMLPKGGEAVWGNLTFAPDDPPITPADAQEGQEESKEEGKEDLVESESKPEPTPEPEPERLSFGNFIRFRNPLSHLSSKNLTIPASIDYLFEQAPEWFKNRTLNHYSYGLARTRKEVKANNDDPSKWSNPLEVALPNAPDMEIYCFYGVGKPTERSYYYQEEVDKDLVNLNISIAHNDPEAVIMGEGDGTISLNTHTMCHRWKDPNSKFNPGGSKVKVVEMLHQPATLDIRGGAKTAEHVDILGRTELNELVLRVAAGRGDEVEERIVSNIDSWVWDIDLGSD

SEQ ID NO: 38 - DNA, 2064 bp, Arxula adeninivorans
atggctgtgaagcgtcggagcaacctcccgcagcaggaggttgatagcgattcatcgagtgatagctcgtcggtgtcgagctctgctgccagcagctcggtagatctggcgacgggttcgtcatcgcaaatcgaagataggttccctaaaaagactgcaagcgcgacaaagcgaagctctcaccatcgcaagagtaagaaagatggtggacacttgagctacaagtggcgtttggcatattccaagcgattggtgttcattatcggaatcatttttgggctgggaattgcgtggtactcggctccgaaggagtttgtgtcattagataggctgtcggagctgtcgttagacgggctgttagacgagtttagagatatgctgcccaaggggatcatgagagaggcccacgatattgataaaaagtcgtatacgctgtccgattcgtttgctgtgggcaattacctgcgggaagaagggtacggggtgaagcatcctgtgatcttgatcccaggagtgatttccactgggctggagtcatggggtctggaggggactgaagagtgtccctcacaaccccatttccgtaaaagactatgggggtcattgtatatgctgcgaacaatgcttctggataagcattgttggctcaagcacattatgctggacccttctactgggctagatcctcccgggtataagatacgtgctgctttgggaatggaatcagccgatttctttgtcccggggtactggttgtggaacaagattttggaaaacctggccgccatggggtacgattccaataacatgcttgtagcttcttacgactggcgtctgtcgtaccctgatttggagcgccgtgatagctattttagtcgcctcaagagtgcaattgagcattctgtacatagtactggcgaaaaagtcgctctggtaggccattccatgggtactcaggtgattttctactttttaaagtgggcagaagctaaaggctacggtgatggaggagatcaatgggtcaatgaccatattgcttctctggttgatatttccggatctaccttgggtactcccaaggccattgtggccctgctttctggtgaaatgaaggatactgtccagcttaatgcgctggctgtgtatggattggaaaagttcttttcccgccgcgaacgagctgatatgctgcggtcatttggtggaattgcttctatgcttccaaagggtggagaggcagtttggggtaacttgacgtttgctccagatgaccctcccattactcctgccgacgctcaagagggccaagaagagagcaaagaagagggcaaagaggacctcgttgagagtgagagtaagcctgaacctacgcctgaacctgaacctgaaagactttcttttggaaatttcattcgattccgcaaccctctgagccacttgtcaagtaagaacctgaccattcccgcgtcaattgactacttgtttgagcaggctcctgagtggttcaaaaatcgaactctgaaccattattcatacgggcttgctcgcacccgaaaagaggtaaaggccaacaatgacgacccttctaaatggtccaatcctttggaagttgcattgccaaacgctccagacatggaaatctattgcttctacggagtgggcaaacctactgaacgcagctactactaccaagaagaagtcgacaaggatttggtcaacctcaatatcagtattgctcataatgatcccgaggctgtgataatgggtgagggtgatggaacaatctccctcaacacccacacaatgtgccaccgctggaaggacccaaactcaaagttcaaccccggaggcagcaaagtaaaagtagtggagatgctccatcagcctgccactctagatattcgtggaggcgcaaagaccgcggagcacgtggatatcttgggccgtaccgagctcaacgagctggtccttcgggtcgctgctggtcgaggtgatgaagtcgaagagcgcatcgtgagcaacattgacagctgggtgtgggacatcgaccttggtagtgattaa

SEQ ID NO: 39 - protein, 642 aa, Arxula adeninivorans
MFRALKSSRTLKISGAVLATGAAAVAVASFRGEDDVKLARRFEARPVPQPPSRSKLIENLKTTEQYDMVVIGGGATGTGVALDAAARGLKVALLERDDFAAGTSSKSTKLVHGGVRYLEKAVWNADYDQYKLVKEALYERRVFLDIAPHLSFALPIMIPLYKYWQLPYYWMGTKCYDLLAGHQNLESSYILTRSKALDAFPMLNDDNLRGAVVYYDGSHNDSRMNVSIALTALEQGADVVNHIEVNQLHKDENGKLKGLTATDLEGGETVNVNAKVIVNATGPFCDSIRQMDDPSTPKIVAPSSGTHIVLPGWFTPKAMGLLDPATSDGRVLFFLPWQGSTIAGTTDDPCEVERNPVPREDQIDFVLHDVRKYFKDKLDIRREDVLAAWSGIRPLVMDPEKMSHGGSQNVVRNHLVTVSPSGLVTIAGGKWTTYRQMAEETVDECVKDFNLSPPKKDVNTANIKLVGAHEWTPLRYIELIQNYDLDPEVAKHLSENYGTRAFTVAELASPPHGKGTAEAPYSTSTRGERIIAPYPFIDGELLYAIRYEYATTAVDFLARRTRLAFLNCNAAFEALPRVIELMGKELNWSSERRKQEYDTSVEYLKAMGLQSPSLQSTSSSIEEAPAAPITAPVSAAIPANPQ

SEQ ID NO: 40 - DNA, 1929 bp, Arxula adeninivorans
atgttccgtgctttgaaaagctctcgaacactaaagatctccggggccgtgctggctaccggagcggcagcggtcgcggtcgcttcttttcgcggtgaagacgacgtcaagctggctcgcaggtttgaagcccggccggtgccccaacccccttctcgatctaagctgattgagaacctcaagactaccgagcagtatgatatggtggtcattggtggaggagctacgggaacgggagtggctctggatgctgctgcccgtggtctcaaggttgccctgctggagcgggacgatttcgctgccggaacttcgtcaaagtccacaaagctggtgcacggaggagtgagatacttggaaaaggccgtgtggaatgccgactatgaccagtacaagctggtcaaggaggctctgtacgaacgtcgagtgtttttggatattgctcctcacttgtcgttcgctctgcctattatgattcctctgtacaagtactggcagctgccttactactggatgggaacaaagtgctacgacctgttggctggccaccagaacctggagtcatcgtacattctcacccgatccaaggctctggacgctttccccatgctcaatgacgacaacctccgtggtgccgtggtgtactacgacggttctcacaacgactctcgaatgaatgtttctattgccctcactgccctggagcagggtgccgatgtggttaaccacattgaagtcaaccagctccacaaggacgaaaacggaaagctcaagggactgaccgctaccgacctcgaaggcggagagacggtaaacgtcaacgcaaaggtcattgtcaacgctaccggtcccttctgcgattcaattcgccagatggatgacccctctacccctaagattgtcgccccctcttctggaactcacattgttctccccggctggttcacccccaaggccatgggtctgcttgaccctgccacttcggacggacgagtactgtttttcctcccctggcagggatccaccattgctggaactaccgatgacccctgtgaggttgaacgaaaccctgttcctcgcgaggaccagattgactttgttctccacgatgttcgcaagtactttaaggacaagctcgacattcgccgcgaagacgtgctggctgcctggtctggtatccgacctctggtcatggaccccgaaaagatgagccatggtggttcccagaatgtggtccgtaaccatttggtaaccgtgtctccttctggcctcgtcaccattgccggaggaaagtggactacctaccgacagatggccgaggagaccgtggacgagtgcgtcaaggactttaacctatctcctcccaaaaaggacgttaacactgctaacatcaagcttgtgggtgcccacgagtggacccctctacgatacattgagctgattcagaactacgacctggaccccgaagtcgcaaagcatctcagtgaaaactatggtactcgagcgtttaccgtagccgaactggcctcccctcctcatggaaagggaactgctgaagccccttactctacttctacccgaggagaacgcatcattgctccttaccccttcattgacggtgaacttttgtatgctattcgttatgagtatgctactaccgctgtggacttcctggcccgccgaactcggttggccttcctaaactgcaatgctgcctttgaggccctgcctcgagtcattgaactcatgggcaaggagctcaactggtcctctgagcgtcgcaagcaggagtacgacactagtgtagagtacctcaaggcaatgggtctgcagtctcctagtctgcagtccacttcttcatccattgaagaggctcctgctgcccccatcactgctcccgtcagtgccgccatccctgcaaacccccagtaa

SEQ ID NO: 41 - protein, 574 aa, Arxula adeninivorans
MDDMDVMPAVGGSRGRIGRYQIIKTLGEGSFGKVKLAYHMATHNRVALKIINRKTLAKSDMQGRIEREISYLRLLRHPHIIKLYDVIKSKDEIIMVMEFAGKELFDYIVQRGKMPEDEARRFFQQIISAVEYCHRHKIVHRDLKPENLLLDDNLNVKIADFGLSNIMTDGNFLKTSCGSPNYAAPEVISGKLYAGPEVDVWSCGVILYVMLCGRLPFDDEFIPVLFKKISGGVYSLPSFLSPGAKSLLQRMLVVNPLNRITVQQIMEDAWFRVNLAEYLLPDAPDENDTAIDDGLVTNLSRTMGYDKEQVYEALLRGDENSEIRDAYALLRDDKLRGKADEVDQYLAASASNVGSPMTGTSDAGTPAAVGFDSGEGRRRRSQTDTSTAANAAQGPGPGFVAPDTTIAILPSSLPAFHRANMQANGPSQMKKLNPVSTKKSKTRWHFGIRSRSYPLDVMGEIYRALKNLGAEWARPLGNDDDLWTIHARWKYDVPQEGDNEDAKGEETELMKMRIQLYQLEQNNYLVDFKFDGWEDTSGRNIKRRLQEFDSFSAYPFLHLSTRLIMELAVNSQAS

SEQ ID NO: 42 - DNA, 1725 bp, Arxula adeninivorans
atggacgacatggacgtcatgcccgcggtaggcggctccaggggtcgtattggaagataccagattatcaagacccttggagaaggatcatttggaaaggtcaagctggcctaccacatggccacccacaatcgagtcgcgctcaagattatcaacaggaaaacattggcaaagtcggacatgcaaggacggattgaacgagagatctcttaccttcgtttgctccgacaccctcatattatcaagctttacgacgttattaaatcgaaggatgagatcatcatggtaatggaatttgctggtaaggaactgttcgattacattgttcagaggggcaagatgcccgaagatgaggcgcgaagattctttcaacagatcatttccgccgtcgagtactgtcaccgtcataagattgttcatcgagatctcaagcctgagaaccttttgttggatgacaatcttaacgtaaagattgctgactttggtctgtccaatatcatgactgatggaaactttctcaagacctcttgtggatcccccaactatgctgcccctgaagtcatctctggtaaattgtatgctggaccagaggttgatgtgtggtcttgtggtgttatcctgtacgtcatgctttgtggacgtctaccgttcgatgatgaattcattcccgtcttgttcaagaagatttcaggcggagtttactctcttccctctttcctgtctcccggagccaagagccttcttcagcgaatgttggtggttaaccctctgaatcgtatcactgttcaacaaatcatggaggatgcatggttcagagtcaacctggctgagtatttgcttccagatgcccctgatgagaacgatacagcaattgatgacggtctggtaacaaatctctccagaacaatgggatatgataaggagcaagtttacgaggctctactccgtggagatgaaaactctgaaattagagacgcctatgcacttcttagagatgacaagctccgaggaaaggcagatgaggtcgatcaatatctcgcggcgtctgcaagcaatgttggttcgccaatgaccggtacttctgatgctggcactccagctgccgtaggtttcgatagtggcgagggacgtcgcagacgatctcagactgatacttcgactgcagccaatgctgcccagggtccggggccaggatttgtagctccagatactacaattgctatcctgccctcatctctgccagcattccacagagctaacatgcaggccaacggtcccagtcagatgaaaaaactgaacccagtatcaactaagaaatcaaagacccgatggcatttcggtattcggtcccgatcataccctctggatgtaatgggagaaatttacagagctctcaaaaacttgggtgcagaatgggcccgtcctctaggaaatgatgacgatctgtggactatccatgcccgttggaaatacgacgtgcctcaagagggtgataatgaagacgcaaagggagaagagacggaattgatgaagatgcgcattcaattgtatcaactggaacagaataattacttggtggactttaagtttgacggatgggaagatactagtgggcgtaacatcaaacgacgtctacaggagttcgactcgttctcggcatatcctttcctccacctttctactaggcttatcatggagttggcagttaacagtcaagcatcataa

SEQ ID NO: 43 - protein, 709 aa, Arxula adeninivorans
MASRLANLGANPTAAVTHDGKEYNTFTEPPVALAQERAKAKFPVRELTYYLDGGEENTKKIEEMMLDIERNPIFSMDDQYDLPMEKNREITMQRVGVLSQYVQAAPEFESLKRFSIVGLIDASTTTRTGVHFGLFFGAVRSSGTNEQLAYWVSKGAGTLRRFFGCFCMTELGHGSNVAGMETTATFDKKTDEFVIHTPHVAATKWWIGGAAHTATHTVCYARLIVDGKDYGVKNFVVPLRDTEDWSLKPGIAVGDIGKKMGRDGIDNGWVQFTHVRIPRQYMLMRYTKVDSEGNVTQPPLDQLSYGALIGGRVSMAVDSSLWAARFLTIATRYAAVRRQFSSTPGEPESKILDYKFHQRRLIPRLAYTFAMRAGSEKLLQFHSKAMENMLNVDKNDKTALNSAIEDMKELFSLSAGLKAFSTWGTAEIIDQCRQSCGGHGYSGYNGFGQGYNDWVVQCTWEGDNNILCLSAGRALIQAGLSARKGGKVGDAASYITRSQELASKKLNGRDIRDPKVLVEAFESASARGINRAVDRYLELTEKKGLNQTQAFEELSQLRFEIARVHTRTYLIRSFFASVEAAKDSIKPVLSDLATLFALWSLEADSAQFLVSGYLSPDDIPQITTLVDEYNGKVREQVIPIIDAFNLSDFFINAPIGQYDGNAYKHYFDKVVRRNPNRESRAPYHERLVKPFMQRPEEEDDEDLEELVED

SEQ ID NO: 44 - DNA, 2130 bp, Arxula adeninivorans
atggccagtcgcctagctaacctgggggctaaccccactgctgctgtcactcatgatggcaaggagtacaacacttttaccgagcctcccgtggccctggcccaggagcgagccaaggcaaagttccccgtccgcgagctcacctactacctcgatggtggtgaggagaacacaaagaagattgaggagatgatgctcgatattgagcgcaacccaatcttctcgatggacgaccagtacgatctgcccatggagaagaaccgagagatcacaatgcagcgagtcggagtgctgtcccagtacgtgcaggctgctcctgagtttgagtctctcaagcgattctccattgttggactgatcgatgcttctactaccacccgtaccggagtgcactttggtctgttctttggtgccgtccgatcctcgggaaccaatgagcagctggcatactgggtgtccaagggagccggaactctgcgacgattctttggatgtttctgtatgaccgagcttggtcacggatctaacgtggctggtatggagaccaccgctacctttgacaagaagaccgacgagtttgttattcacactcctcacgttgctgccaccaagtggtggatcggaggagctgctcacactgccactcacactgtgtgctacgcccgtctgattgtggacggaaaagactatggtgtcaagaactttgttgttcctctgcgagacactgaggactggtccctcaagcctggtattgctgtgggtgacattggtaagaagatgggacgagatggaattgacaacggttgggtccagttcacccacgtgcgaatccctcgtcagtacatgcttatgcgatacaccaaggtcgactctgagggtaacgtcactcagccccctcttgaccagctttcgtacggtgctctgatcggaggtcgtgtgtccatggccgtggactcctctctgtgggccgctcgtttcctgaccattgctacccgatacgctgccgttcgtcgtcagttctcttccactcctggtgagcccgagtctaagattctggactacaagttccaccagcgacgattgattcctcgtctggcttacacttttgccatgcgagctggttcggagaagctgctgcagttccactccaaggctatggagaacatgctcaacgtggacaagaatgacaagaccgccctcaactctgccattgaggacatgaaggagctgttctccctgtcggctggtctcaaggccttctcgacctggggaaccgccgagattattgaccagtgccgtcagtcctgtggtggtcacggatactctggatacaacggattcggccagggttacaacgattgggttgtccagtgcacctgggagggagacaacaacattctgtgtctgtctgccggccgagccctcatccaggccggtctgtctgcccgcaagggaggaaaggttggtgacgccgcctcttacatcacccgatcccaggagctggcttccaagaagctcaatggccgggatatccgggaccctaaggtgctggtcgaggcatttgagtctgcttccgctcgaggtatcaaccgtgctgtagaccgatacctggagctgaccgagaagaagggtctgaaccagactcaggcgttcgaggagctgtctcagctgcgattcgagattgcccgagtccacactcgaacctacctgatccgatccttctttgcctctgtggaggcggccaaggactccatcaagcccgttcttagcgacctggccactctgtttgctctgtggtctctggaggctgactctgctcagttcctggtatctggatacctgtctcccgatgacattcctcagatcactactctggttgacgagtacaacggcaaggtccgagagcaggtcattcctatcattgatgctttcaacttgtctgactttttcatcaacgcccccattggtcagtacgatggaaatgcttacaagcactactttgacaaggttgtgcgacgaaaccccaaccgggagtcgcgagctccttaccacgagagattggtcaagccattcatgcagcgtcctgaggaggaagatgatgaggatcttgaagagcttgtggaggactag

SEQ ID NO: 45 - protein, 518 aa, Arxula adeninivorans
MEERLIAALDQGTTSTRVIVFTETGHAVASFQREMVTEAPEPGHVEQDPDVFEKNAKECFSKCVEQLNEKGIDPARVVTIGITNQRETTILFDRKTGKPVYNALVWSDARTADVAQTLKKKKGADRIQHLCGLPISTYFAGIKVRWLLDNVPEAKEVYDRGDLAFATVDSWILYRLTGGNHVTDVTNASRSMFMNIEKLKYDDELIEFFGVEKLVLPEIRSSSGYFGDMKEGFPLAGTPIRGCIGDQSSALIGHFGFSQGDVKNTYGTGCFLLYNTGKECVRSENGLISTLLFQDKDNNTLYGLEGSVAVAGSVIKWFKNNVGLIELSSQIGELAEQVEDNGGVSFVTAFSGLFAPYWNENATGTIVGLTHFSEAGHLARAAIEAVCFQTRAILDTMVRESGTKFTQLRVDGGMTASNITMLTQANILGIDVVRPAMREPTALGAALTAGLAHGVWDNWEEAKKSMAHLSKATTFSPEWDAELREYEYARWTLAVEAASVYGDRLQELKQWGTQRAHQ

SEQ ID NO: 46 - DNA, 1557 bp, Arxula adeninivorans
atggaagaacggttgattgctgctctagaccagggaacgacgtcgactcgagtcattgtgttcaccgagaccggccatgcggttgcgtcgtttcagagggagatggtgacggaggctccggagccgggccacgtagagcaagacccggatgtgtttgagaagaacgctaaggaatgtttttccaaatgtgtagagcaactcaatgaaaagggcattgatccggctcgggtggtgacgattggaatcaccaaccagcgagagaccactattctgtttgaccgaaagactggcaagcccgtgtacaacgctctggtgtggtcggatgctcgaactgcggacgttgcccagacgttgaagaagaagaaaggagctgaccggattcagcacctttgtggactgcctatttcgacgtattttgccggaatcaaggtgagatggctgctggacaatgtgccagaggcaaaggaagtgtacgaccgaggagacctggcgtttgcaacggttgattcgtggatcttgtaccgactgacaggaggtaaccatgtgacagatgtcaccaatgcttcgcgatccatgttcatgaacattgaaaagctaaagtatgatgatgagctgattgagttttttggggtcgaaaagctggtgctgccagagattcgttccagttcaggctactttggtgacatgaaggaaggattcccattggcaggcactcccattcgtggatgcattggagaccagtcgtcagcattgattggacactttggattctcccagggagacgtcaagaatacctatggaactggatgtttcctgctatacaatactggaaaggaatgcgtgcgatcagaaaacgggctcattagtactctattgttccaggataaggacaacaacactctatatggtctagaaggatctgtagcggtagccggtagtgtgatcaagtggttcaagaacaatgtgggactgattgagctgtcttcgcagattggagaactggcagagcaagtagaggacaatggaggggtgtcatttgtcacggccttttcaggactgttcgccccatactggaacgagaacgctactggtaccattgtaggcctcacgcatttctcagaggcgggccatctggcgcgagcggccattgaggcggtgtgtttccagactcgagccattttggacacaatggtgcgggaatcaggaacaaagttcacccaactgcgagtggacggaggaatgactgcatcgaacatcacaatgttgactcaggctaacattttgggcattgacgtagtacgaccggcaatgagagagcctacggcattgggagcagctctgactgccggacttgcacatggagtatgggacaattgggaagaagccaaaaagagcatggctcatctgtccaaggcgacaaccttttctcctgaatgggatgccgaactgagagagtatgaatatgctcgatggaccctagcagtagaggctgcctctgtatatggagaccgtctacaggagttgaagcaatggggtactcagagggcccaccagtag

SEQ ID NO: 47 - protein, 710 aa, Arxula adeninivorans
MTSESIDTGLNFKTWLYDLVLWIFQVTFNIFFREILSRGAFRIPKSGPVIFVGAPHANQFVDPMLLMQQAKGVAGRRLSFLIAETSLRRKFIGAIARATQSIGVVRAQDNLKPGSGKISVDADNGTRIIGEGTKFTTECMVKGIIGLPQQAGSAEIAEIVSDTELILRKEFKGAKAASLLKRGTSYKRADHVDQSKMYRQVFDHLHKGGCLGIFPEGGSHDRTDLLPLKAGVAIMALGAIMEYPDLDVKIVPCGMNYFHPNKFRSRAVIEFGSPMTIPRELVEMYKQGGEQKRDAVKQLLDQVADGLRTVTVTTPDYETLMVVQAARRLYRPPNKKLPLPVVVELNRRLIRGYEKYKDDPKIVHLRNAVLSYNKKLKGLGLKDHQVETATLSPHKVVFKFLYRLSKLLVLAPLAMPGAIMFSPVFVATKLISRKRAKQALAKSTVKVQARDVVATWKVLVAMGLAPCLYTVYALVATYICYKKQWVSSELWSLAKVMIASYIVFPAITWSALVIGETGMDIFKSLRPLALALNPFHKNAIEELRETRRNLVMEVSEVVNSLGPELYPDFGKYSFRYNEYQYKEEKLANGKVEEAEETEEAKEAKEDEEENVVVAKRRTSSASTDTNVSSDSNSISRVNSESGLANIPLFSSADPVSNHSRASSGSSALSMEVPDTTTATGQKVFQSEVSKRIRGAMEERIRARMEESDEE

SEQ ID NO: 48 - DNA, 2133 bp, Arxula adeninivorans
atgactagcgaaagcatagacacaggactaaatttcaagacatggctctacgatctagtgctatggatctttcaggtgacatttaacatcttcttccgagagattctttctcgaggagcattcaggatcccaaagtccggccccgtcatctttgtaggagcacctcatgctaaccagtttgtagatccaatgctgctgatgcagcaggccaagggagttgcgggccgtcgtctttcgtttttgattgctgaaacgtcgttgcgacgcaagtttattggcgcaattgcccgggccacccagtcaattggagtggtacgtgctcaggacaatttgaagcctgggtctggtaagatttcagtagatgccgacaatgggacccgtatcattggtgagggaacaaagttcaccactgagtgtatggtcaagggtataattggattgcctcagcaagcgggcagcgcagagattgctgaaattgtcagcgacactgagctgattctgcgaaaggagtttaagggcgcaaaggctgcttctctgcttaagcgaggaacttcatacaagagagcagaccatgtggatcagtcgaaaatgtaccgtcaagtgtttgaccatcttcacaagggtggatgccttggtatctttcccgaaggaggatctcatgaccgtactgacctgttgcctttgaaagctggtgtagcgattatggctctgggggccattatggagtatcctgacctggatgtgaaaattgttccctgtggtatgaactatttccatcctaacaagtttagatcccgagcagtcattgagtttggaagtcccatgaccattccccgggagttagtagaaatgtacaaacaaggaggtgaacagaaacgagatgcagttaagcaattgcttgaccaggttgctgatgggctgagaacagttactgtaaccactcctgattacgagactctgatggttgttcaagcagcccgacgattgtaccgccctcctaacaagaagctgccgttgccagtggttgtggaactgaaccgccgactgattcgtggatatgaaaagtacaaggacgaccccaagattgttcatctcaggaatgcagtcttgtcgtacaacaaaaaactcaagggactgggcctcaaggatcaccaagtagaaactgccaccctctctcctcacaaggttgtattcaagtttttgtatcgactttcaaagctgctggttctggcccctctggctatgcctggtgccatcatgttctctcccgtgtttgtggctaccaagctgatctctaggaagcgggccaaacaggcacttgccaagtctactgtcaaagtgcaggctcgcgatgtggtagccacctggaaggtacttgttgccatgggattagcaccatgcttgtataccgtttacgctctagtggccacttacatttgctacaagaagcaatgggtatcctcagagctgtggtcgttggctaaggtaatgattgcttcgtacattgttttccctgctattacctggtctgctttggtgattggtgagaccggtatggacattttcaagtccctgcgccctctggcgttggcgctcaacccattccacaagaatgctattgaagagctccgagaaactcgacgcaatttggtcatggaagtttctgaagttgtcaattccctcgggcctgagctgtacccagactttggcaagtactctttccgatacaacgaatatcagtacaaggaggagaaactggccaacggcaaagtcgaagaggccgaagagaccgaagaggccaaagaggccaaagaggacgaagaagaaaatgtggttgtggccaaacgacgcacgagcagtgcgtctacagatactaacgtttcatcggattccaattccatctctcgagtcaactcggagtctggcctggccaatattcctctgttttccagcgctgatccagtaagcaaccactctcgagccagttccggttcgtctgcgttgagcatggaagtgccagataccaccactgccactggacagaaggtgttccagtctgaggtatccaagcgaattcggggtgccatggaggagagaatccgagctcgaatggaagagagcgatgaggagtag

SEQ ID NO: 49 - protein, 742 aa, Arxula adeninivorans
MQYVGRAIGSVSKTWNSINPATLSGAIDIMVVEQPDGTLSCSPFHVRFGKFSLLRPSQKKVQFSVNGEATDLPMKLGDGGEAFFVFETPNKVPSDLLTSPVVSPSSSPESIVADDEDAEGRPLQEPEFLDLSRTEPERARSESPQRPPNKDGSLRSADSFPPPPANNAQWSESSPSLTEAPPLSPGEPEPERAISKDRVHSLTKRLTDINIPSKITDNGDIVLDMTGYKSGADEFRTSEAVVKKLLAEELGLGPELDFESIMGPDEEGNIRIYSRDDLYAATAGHRHSHSHHPFPSAEDTAPVTPAPESSSSSSEPASTEGTPTAGEPFYAKTLRLTSDQLKKLNLKSGRNEVQFKVLQNKAVINAHLYYWKSNAPIVISDIDGTITKSDALGHVLTMLGRDWTHSGVAKLYVDIANNGYNIVYLTARSVGQADATRYYLQGIEQEGYRMPPGPVILSPDRTMAALRREVIMRKPEVFKMAALRDIQSLYDYKEGTPFYAGFGNRITDALSYRSVGIPSSKIFTINTNSEVHMELLELAGYRSSYVHIADLVDHFFPPVVASGGKDVENKYSDVNFWRDPIPDISDLESLDGFEDEGPKSPKSPEQRAKSPSDMLSSSQSPQKANEKTSDKSGPMDMGPPVMSSEKKSDKGEEDEDDEDYDEDYEDDNYEDEYDDYEYDEDEYDDYDYENEDYQDGETPDERQGRSRQRRSIVYTHFGAREPAHLEQARTLRETLKDINTNL

SEQ ID NO: 50 - DNA, 2229 bp, Arxula adeninivorans
atgcagtacgtaggacgagcgattggatctgtgtccaagacatggaactccatcaaccctgctacgctgtcgggagcaattgatatcatggttgtggaacagcccgatgggactctgtcgtgctctccctttcatgtccggttcggcaagttctcgttgcttcgtccctcgcagaagaaggtccagttttccgtaaatggggaggccactgacttgccaatgaagttgggggatggcggcgaagcgttctttgtgtttgagactcccaacaaggtccccagtgacctgttaacttcaccggtagtgtccccgtcgtcttcaccagaatcgatcgtagcggatgatgaggatgccgaaggacgccctttgcaagagccggagtttttggatctttcccgtactgaacctgagagagctcgctctgaaagccctcagcggccacccaacaaggacggatctctacgaagcgctgattcgttccctccgccacctgccaacaacgcccaatggagcgagtccagtcctagtttgaccgaggcgccgccgctgtctccaggagagcctgaaccagagcgggccatttcaaaggaccgggttcatagtctgaccaagagattgactgatatcaatatcccatccaagatcaccgacaatggcgacattgtgctggacatgaccgggtacaagagcggtgcggatgagtttagaacttcagaagcagtagtaaagaagcttttggctgaggagcttgggctgggtcccgagctcgattttgaatccatcatgggccccgacgaggagggcaatattcgtatttattcccgtgacgatttgtatgctgccacggcaggccaccgccatagtcactctcatcatcccttccctagtgctgaggacactgcgccggtgacccctgcccctgagtcctcttcgtcatcatctgaacctgcatctaccgaaggcactcccaccgccggagagcccttctatgcaaagacgttgcgattgacttcggatcagctcaagaagctcaatctcaagtctgggcggaatgaggtccagtttaaggtgctccaaaacaaggccgtgatcaacgctcacctgtactactggaaaagcaacgccccaatcgtcatttctgatatcgatggaaccattacaaagtcggatgccctgggccatgtcttgaccatgcttgggcgggactggactcactctggggtcgccaaattatatgtggatattgctaacaatgggtacaatattgtatatttgaccgcacgatcagttggccaggcagatgctactcgatattatcttcagggaattgagcaagaagggtatagaatgccccctggtccagttattttgtctccagataggacaatggctgccttgcgccgagaggttatcatgcgcaaacccgaggtgttcaagatggccgcccttcgggatatccagtctctgtacgactataaagagggcaccccattttatgcagggtttggtaatcgtatcaccgacgcgctatcttatcgatcggtgggaatcccttcgtcgaagatcttcaccatcaataccaattctgaagtccacatggaactcctggagttggcagggtaccgctccagctacgtccatattgccgacctcgtggaccactttttccctccagtggtggccagtgggggtaaggatgtggaaaacaagtattccgatgtcaatttctggcgagaccctatccctgatatttccgacctggaatctctagatggatttgaagatgaaggaccaaagagtccaaagagccctgagcagcgagccaaatcaccatctgatatgctttctagtagtcaatcccctcagaaagctaacgagaagacctccgacaaatcagggcccatggacatgggtcctccagtcatgtcatccgaaaagaagagcgataagggcgaagaggacgaggatgatgaggactacgatgaggactacgaagacgacaattacgaggatgagtatgatgactacgagtatgacgaggatgaatatgatgactatgattacgagaacgaggactatcaagacggagagacccctgatgaaagacagggtcgctctaggcaacggcgatcgattgtatacacccatttcggtgcccgagagcccgcccatttggagcaggcacgcactctgagagagactctcaaggatatcaatactaacttgtaa

SEQ ID NO: 51 - protein, 334 aa, Arxula adeninivorans
MLEVTFPPTLDRPFGVYLYGLFDALTNGWATRFQFAQDSGIPFSSRWEVAAGIVTYYVVIFGGREVLKNAPVIRLNFVFQIHNLILTLLSLGLLLLLVEQLIPIIVRHGVLYAICNSGSWTQPIVTVYYLNYLTKYYELFDTVFLVLRKKPLTFLHTYHHGATALLCFTQLIGHTSVSWVPIVLNLFVHVIMYYYYFLSALGVRNIWWKEWVTRTQIIQFVVDLVFVYFATYTYFTNKYWPWLPNKGTCAGEEFAAIYGCALLTSYLFLFIAFYIRVYTKAKAKGRKRAASAAAKATTGVVTADRPSTPIATTNGAATGAAGATGSVKSRSRKA

SEQ ID NO: 52 - DNA, 1005 bp, Arxula adeninivorans
atgctggaagtcaccttccccccgaccctggaccgcccctttggcgtgtacttgtacgggctgtttgacgcgttgaccaacggatgggcaacccgattccagtttgctcaggactctggcatcccctttagctcccgctgggaagtggccgcgggcattgtcacctactacgtggtcatctttggcggccgcgaggtgctcaagaatgccccggtgattcgtctcaactttgtgttccagattcacaaccttattctgaccctgctgtccctgggtctgttgctgctgctggtggagcagttgattcctatcattgtgcgccacggagtgctgtacgccatctgcaactctggatcgtggactcagcctattgtgaccgtgtactacctcaactacctgacaaagtactacgagctgtttgacactgtgttcttggtgctgcgaaagaagcctctgaccttcttgcacacttaccaccacggagccaccgctctgctgtgcttcacccagctcattggccacacctcggtgtcgtgggtgcccattgtgctcaacctgtttgtccatgttatcatgtactactactactttttgagcgctctgggagttcgcaacatctggtggaaggagtgggtcactcgaacccagatcatccagtttgtggtggacctggtgtttgtgtactttgctacctacacctactttaccaacaagtactggccctggctccctaacaagggcacttgcgctggtgaggagtttgctgccatctacggatgtgccctgctcacttcgtacctgttcctgttcattgccttttacattcgcgtgtacaccaaggcaaaggccaagggtcgcaagagagctgccagcgctgctgccaaggccaccactggcgttgtcactgccgaccgtccttccactccaattgctaccaccaacggagctgccactggcgctgctggagccactggttcggtcaagtctcgatcgcgcaaggcctaa

SEQ ID NO: 53 - protein, 1852 aa, Arxula adeninivorans
MRPEVEQELAHVLLTELLAYQFASPVRWIETQDVILSQFNAERMVEIGPSPTLAGMAQRTIKSKYESYDSALSLQREILCYSKDTKEIYYTPDPVEEPKEAAAPAAGESSAPAAAPAAAAAAPAAPAAAAAAPSGPVEAVSDTPVKAVEVLQALVAQKLKKTIDQVPLTKAIKDLVGGKSTVQNEILGDLGKEFGSTPEKPEETPLGELAEQFQDSFSGQLGKQSSSLISRFISSKMPGGFSITNARKYLTDRWGLGPGRQDSVLLLALTLEPKNRLGAEPEAKAFFDDVANKYAAAAGISLSSGASSGGSGGGSGGAVIDSAAFEELTKDQKYLVQQQLELFARYLKVDLRSGDKQFVAQKEATAVLQAELDLWNAEHGEFYASGIKPTFSPKKARVYDSYWNWARQDSLLMFYDIIFGRLSTVDREIVARCISIMNRANPTLIDFMQYHMDHVATHKGDTYKLAQELGLQLLENCKEALTADPVYKDVNYPTGPKTTVDSKGNISYEEVPRSSARKLEQYVLDMAKGGEITKDPASGTHATAELARIYKNLSQQHAGSADFNTKLQSLYGDLVKLIEEADQNPAAVSKAATASQSIGKDTVPFLHLKKRTGEEWAYSRDLSSLYLDGLESAARDGVTFANKYVLVTGAGAGSIGADILQGLLAGGAKVVVTTSRYSRQVTEYYQSIYARFGASGSTLIVVPFNQASKSDVSALVEYIYDSPKNGGLGWDLDFIIPFAAIPENGIEIDGIDSKSELAHRLMLTNLLRLLGNVKTQKATRGYETRPAQVILPMSPNHGTFGADGLYSESKLSLETLFNRWYSESWASYLTICGAVIGWTRGTGLMSQNNIIAEGVEKLGVRTFSQKEMAFNILGLMTPAVVNICQQEPVWADLNGGLQFISNLKDVTAKLRKDLMDSSELRRAVSVETAIEHKVVNGPDADLPYQKVTVKPRANHKFEFPRLKSYEELKEVAPELEGMLDPERVVVVTGFSEVGPWGNSRTRWEMEAHGAFSLEGAIEMAWIMGLIKHHNGPLKGKPYTGWVDTKTNEPVDDKDVKSKYESYILEHSGIRLIEPELFNGYDPNKKQFMQEVIVEHDLEPFEASKEAADQFKLEQGDKVEVFEIGDSGEWSVRFLKGARVFIPKALKFDRLVAGQIPTGWDARRYGIGEDIISQVDPITLYVLVSTVEALLSAGITDPYEFYKYVHLSEVGNCSGSGMGGVSALRGMFKDRFLDNPVQNDILQESFINTMSAWVNMLLLSSSGPIRTPVGACATAIESVDSGMELILAGKAKVVIVGGYDDFQEEGSHEFGNMNATSNSVTEMEQGRTPAEMSRPNTTTRSGFMESQGAGIQILMNAKLAVDMGVPIYGIVAMTSTATDKIGRSVPAPGKGILTTAREKVSDLKYPYRVLDIKYRKRQLDLRKNQIGQWVESELSYLQDELAALGDDVDKTAFYKERTEQIQAEARRQEKEALNTWGNEFYKQDPRIAPLRGALATYNLTIDDLGVASFHGTSTKANDKNESGAINTMLNHLGRSKGNPVLGVFQKYLTGHPKGAAGAWMLNGVLQVLNTGLVPGNRNADNIDQVMKDFDKVVYPSVTVQTDGVKAASVTSFGFGQKGAQAVVIHSDYFFATLNKPTYEAYAKKVAARYNKAYRYLHNAIAENSMFVAKDKAPYTEDQESTVYLNPLARIDYENKSKSLVFKKTKGTEASASGSTAHTADVLAQMAQSTVGAGSNVGVDVESITAVNIENATFVERNFTEEEQKYCFASADPQSSFAGTWSAKEAVFKSLGVESKGAGAALKSIEIVRDAKGAPQVVLHGDAKSAATASGVTNVKVSISHNDLQAVAIAVSEK

SEQ ID NO: 54 - DNA, 5559 bp, Arxula adeninivorans
atgcgccctgaagtagaacaggaactcgcccacgttctgttgacagaactgctggcttaccagtttgcgtccccggtcagatggatcgagacccaggatgtcattctgtcccaattcaatgctgagcgaatggtggagattggtccctcgccaactctggccggaatggcccagcgaaccatcaagtccaagtacgagtcgtacgactcggctctgtctctgcagcgtgagattctgtgctactccaaggacaccaaggagatttactacactcccgaccctgtcgaggagcccaaggaggccgctgctcctgctgctggtgagtccagtgctcccgctgctgctcccgctgccgctgctgctgctcctgctgctcctgctgccgctgctgctgctccctctggacctgtggaggccgtgtccgacactcctgtcaaggcagtggaggtgctgcaggctctggtcgctcagaagctcaagaagaccattgaccaggtgcctctgaccaaggccatcaaggatctcgtgggcggaaagtccactgtgcagaacgagattctcggagatcttggaaaggagtttggttctactcccgaaaagcctgaggagactcccctgggcgaactcgccgagcagttccaagactctttctctggccagctcggaaagcagtcgtcttcgctcatttcgcggttcatctcctccaagatgcccggtggtttctccatcactaacgctcgcaagtacttgaccgaccgatggggtcttggaccaggtcgccaggactcggtgctgctgctggcgctcaccctggagccaaagaaccgtctgggagccgagccagaggcaaaggcattcttcgacgacgtcgctaacaagtacgcagccgctgctggcatttctctgtcgtctggagcttcttccggaggctctggcgggggctctggcggagccgtcatcgactcggccgccttcgaggagctcaccaaggaccaaaagtaccttgtgcagcagcaattggagctgtttgcgcgctacctcaaggtggaccttcgttctggagacaagcagtttgttgcccagaaggaggctaccgcagtgctgcaggccgaattggacctgtggaatgctgaacacggagagttctacgcttccggaatcaagcctaccttctcccccaagaaggcccgtgtgtacgactcgtactggaactgggcgcgccaggactcgctgctcatgttctacgacattatctttggccgtctgtccaccgtggaccgtgagattgtagctcgctgcatctccatcatgaaccgagccaaccctactctgatcgactttatgcagtaccacatggaccacgtcgctactcacaagggcgacacttacaagcttgcccaggagctgggtctgcagctgttggagaactgtaaggaggctctgaccgctgaccccgtgtacaaggacgtcaactacccaaccggtccaaagaccactgtcgactccaagggtaacattagctacgaggaggtgcctcgctcgtctgcccgtaagctggagcagtacgtgctggacatggccaagggcggtgagatcacaaaggaccctgcctctggcacccacgctactgccgagctggctcgcatctacaagaacctgtcgcagcagcacgctggttcggccgactttaacaccaagctgcagtcactgtacggagaccttgtcaagctcattgaggaggccgaccagaaccctgccgcggtgtcaaaggcagccactgcgtcgcagtcaattggcaaggacactgtccccttcctccacctcaagaagcgcactggagaggagtgggcgtacagccgagacctgtcgtctctttacctggacggcctggagtctgctgcgcgcgacggtgtcactttcgccaacaagtacgtgctggttactggtgcgggagctggctctattggcgctgacattctgcagggtctgcttgctggaggagccaaggttgtcgtcaccacctcgcgatactcgcgccaggtcaccgagtactaccagagcatctacgcgcgcttcggagcttctggctctactctgatcgtggtgcctttcaaccaggcgtccaagtcggacgtcagcgcactggtcgagtacatctacgactcgcccaagaacggcggtctgggatgggatctggactttatcattcctttcgctgccattcctgagaacggtatcgagattgacggcatcgactcaaagtccgagctcgctcaccgtctcatgctcaccaacctgctgcgtctgctcggaaacgtcaagactcagaaggcgacccgtggctacgaaacccgacctgcgcaggtcattctgccaatgtcgcccaaccacggaacctttggcgccgacggtctgtactcggagtccaagctgtcgctggagacgctgttcaaccgatggtactcggagtcgtgggcatcctacctcaccatctgcggagccgtcattggatggacacgaggcaccggactcatgtcgcagaacaacatcattgctgagggtgtagagaagctcggtgtgcgcaccttctcgcagaaggagatggcgttcaacattctgggactaatgactcctgccgtggtcaacatctgccagcaggagcctgtctgggctgacctcaacggaggtttgcagttcatctccaacctcaaggacgtcaccgccaagctgcgaaaggacctgatggactccagcgagctgcgacgagctgtttccgttgaaactgccattgagcacaaggttgtcaacggtcccgacgctgacctgccctaccagaaggtgaccgtcaaaccgcgagccaaccacaagttcgagttccctagactaaagtcgtacgaggagctcaaggaggttgctcccgaactcgagggaatgctggaccctgagcgcgtcgtcgtagtgaccggtttctcagaggtcggaccctggggtaactcgcgaacccgatgggagatggaagcccacggagcgttttcgctggagggagccattgagatggcgtggatcatgggtctcatcaagcaccacaacggtcctctcaagggcaagccatacaccggatgggtcgacaccaagacaaacgagcccgtggacgacaaggacgtcaagtccaagtacgagtcgtacattctggagcactccggaatccgtctcatcgagcccgagctgttcaatggctacgaccccaacaagaagcagttcatgcaggaggtcattgtagagcacgatttggaaccttttgaggcatccaaggaggccgccgaccagttcaagctggagcagggcgacaaggtggaggtgtttgagattggcgactctggcgagtggtctgtgcggttcctcaagggcgcacgcgtgttcatccccaaggctctcaagttcgaccgcctggttgctggccagattcctaccggctgggacgctcgccgatacggaattggcgaggacatcatctcccaggtcgaccccatcaccttgtacgtgctggtgtccaccgtggaggctctgttgtccgctggtatcaccgacccttacgagttctacaagtacgtgcacctgtccgaggtcggaaactgctctggttccggtatgggaggagtgagcgctctgcgaggaatgttcaaggaccgattcctggacaaccctgtgcagaacgacattctgcaggagtcgttcatcaacacaatgtctgcatgggttaacatgctgctgctgtcttcttcgggtcctattcgcacccctgtgggagcttgcgctactgcaattgagtctgtggacagcggaatggagctcattctggccggtaaggccaaggtggtcattgtgggaggatacgacgacttccaggaggagggctcgcacgagtttggtaacatgaacgctacctccaactcagtcaccgagatggagcagggtcgaactcccgctgagatgtcgcgtcccaacaccaccacccgatctggattcatggagtcgcagggtgccggtatccagattctcatgaacgcaaagctggcggtcgacatgggtgtgcccatctacggtatcgtggccatgacctccactgccactgacaagattggccggtcggttcctgctccaggaaagggtatcttgaccactgcccgcgagaaggtgtctgacctcaagtacccttaccgcgtgctggacatcaagtaccgaaagcgacagctcgacctgcgcaagaaccagattggccagtgggtggagtccgagctgtcgtacctccaggacgagctcgctgctctcggtgacgacgttgacaagaccgctttctacaaggagcgcaccgagcagatccaggcagaggcccgccgccaggagaaggaggctctcaacacctggggtaacgagttctacaagcaggacccccgaattgctcctctgcgcggagctctggctacctacaaccttaccattgacgacctgggagtggcctcgttccacggaacgtccactaaggcaaacgacaagaacgagtctggcgcaatcaacaccatgctcaaccacctgggtcgttccaagggtaaccccgtgctgggagtgttccagaagtacctcactggtcaccccaagggagctgccggagcgtggatgcttaacggagtgctccaggttcttaacactggtctggttcctggtaaccgcaacgctgacaacattgaccaggtcatgaaggactttgacaaggtcgtgtaccccagcgtgactgtgcagaccgacggagtcaaggctgcctcggtcacttcgttcggtttcggacagaagggtgcccaggcagtggtcatccactcggactacttctttgctactctcaacaagcctacgtacgaggcctacgctaagaaggtggctgctcgttacaacaaggcctaccgatacttgcacaatgccattgctgagaactccatgttcgtggctaaggacaaggctccttacaccgaggaccaggagtccaccgtgtacctcaaccctctggcccgtatcgactacgagaacaagtccaagagccttgtgttcaagaagaccaagggcaccgaggccagcgcttctggctctactgctcacactgctgacgtgctggcccagatggctcagtctactgtgggcgctggcagcaacgtcggtgtcgatgtggagtccatcactgctgtcaacattgagaatgccacctttgtggagcgcaactttaccgaggaggaacaaaagtactgctttgcatctgctgaccctcagtcgtcgtttgccggcacctggtctgctaaggaggcagtcttcaagtctctgggagtcgagtccaagggagctggagctgctctcaaatccattgagattgtccgcgacgccaagggagctcctcaggtagtgcttcacggagacgcaaagtctgctgccactgccagtggagtgaccaatgtcaaggtgtccatttcgcacaacgatctccaggccgttgccattgcagtttctgagaaataa

SEQ ID NO: 55 - protein, 2084 aa, Arxula adeninivorans
MYGAATGVSTPHSAASLRPLVLSHGSVEHTLLVPTSLYLNFTQLRDQFQSSLPAPTEDLSGDGEPASSAELLAAFLGYAAALVEAEPGPYDDVLTLALTEFETRYLRGNDVHAVAAKLQADESAVTTAAKVKKVVKSYYAARLAANRPMKPYESALLRAVHDKEALVHAIFGGQGNTEDYFDELREIYDIYNGAIVDFIELVAEKLLSLSREHPDASKIYTKGLDILRWLKNPETTPDNDYLVYAPVSVPVIGVIQLAHYAITARVLGLTPGDLRNYLAGATGHSQGMVTAVAIASSDSWESFFEASVKAMTVFFYIGLRCQQQYPHTSLPPSVLEDSVAEGEGKPSPMLSIRDLSKSQVQKFVDDTNKHLPKEKHIVISLINGARNMVVTGPPQALYGLNLALRKAKAPTGLNQGRVPHSERKLKFSSRFLPITSPFHSPLLTDATDVIVNDLKTANVEFAPSSLSIPVYDTFEGADLRESKGSVVARVIELITHLPVNWEIATQFSGTHILDFGPGGASGLGLLTHRNKEGTGVRVIIAGVLDGSNTDDEFGFKQEIFDREEGTVKYAIDWVKEFSPQLVKTTSGETFVDTKFSRLLGRPPIMVPGMTPTTVRPEFVSATLNAGYHIELGGGGYFMPSMLTAALEKIEKATKPGVGITLNVLYVNPVMLQWCIPLIERLRNDGFPIEGLTIGAGVPSVEVANEYIRNLGLKHISFKPGTVESIATAIAIAKANPTFPVVIQWTGGRGGGHHSFEDFHSPILQMYAKIRRQPNIILVGGSGFGSHVDTYPYLTGEWSTKYSYPPMPYDGFLMGSRCMVAKETFTSPDAKKAIVEAPGVEDKDWEKTYKGPTGGVITVLSEMGEPIHKLATRGVLLWKELDDSIFSLPRNKRVEALNAKRDYIIKRLNDDFQKVWFGRNAAGEVVDLEDMTYMEVVSRLVDLLYVKKESRWIDISLRNFTGDVIRRLEERFTTESGKLSVVQSFSQLDEPFKMLEQIAEAYPEAKNQIINAQDKDYFLMLSRRPTQKPVPFVPVLDDNFEWYFKKDSLWQSEDLAAVVGEDVGRTCILQGPVAVRFSNEVNVPIKDILDSVHNGHIELLLKDVYKGDQSKIPVIESFGFKPAKSSSQLLSKNLTSVTSTFDGDNEVHKIDSSPTSSALPSAEQWLDLLAGSQSNWRHSLLSTNIIVQGTKHRPNAIRAILSPVRGLRVEIANASDPEKTKLTVWEPINGKLTKVIEISKVSKDVIKVLLIEERTSERKPVALELLYNYMPECGFAPIQEVMQDRNDRIKEFYWNAWFGSTENCNTDIDITKPWDGDSITVEAKSVADFVHAVGNNGEAFVSRPNKVMYAPMDFAIVTGWKAIIRAIFPKVIDGDILRLVHLSNGFRMFPGAEPLKVGDVISTTASLKAVMNQASGKIVEVSGILRRDGQPVMEVTSQFLYRGAYSDFENTFQNKEETPMEVQLKTAKDVAVLCSKEWFQVDDSSIDLLGQTLTFRTQTSVRFKSEKVFSSVKTTGQVLLELPTKEVIQIATVDYEAGESFGNPVIDYLQRHGKTIEQPVHFENAIPLNVGTVLASRAPSSNESYANVSGDYNPIHVSRVFAKYVNLAGTITHGMYSSAVVRSLVETWAAENNITRVRGFNCKFVGMVLPNDDIETKLEHIGMINGRKIIKVESFKRETQEPVLVGEAEVEQPVSSYVFTGQGSQEQGMGMDLYESSPVARSVWDRADRHFQENYGFSIVDIVKNNPKELTVHFGGPQGRAIRDNYISMMFESVDEEGNIKSEKIFKDITEDTDFYTFRAPTGLLSATQFTQPALTLMEKASFEDMKSKGLIAADSPFAGHSLGEYSALTSLADVMPIESLVDVVFYRGMTMQVAVPRDAAGRSNYGMVAVNPSRVSATFNDTALRFVVEHIAAQTKWLLEIVNYNVENQQYVAAGDLRALDTLTNVLNFVKVQKINIDKLLETLPVEKVKEHLSEIVTEVAAKSVAKPQPIDLERGYAVIPLKGISVPFHSSYLLSGVKPFKRFLVKKVPRSAVKPASLIGKYIPNLTAKPFQITKEYFQEVYDLTGSDKIKNILDNWEKYESS

SEQ ID NO: 56 - DNA, 6255 bp, Arxula adeninivorans
atgtacggagcagctactggtgtatctactccccattcggccgcttcgctgcgtcctttggttctttctcatggctctgtcgagcacaccttgttggtgcccacttcgctctacctaaatttcacccaactgagagaccaatttcagtcttcgcttcctgcccctactgaagacctcagcggtgacggcgaacccgcgtcgtccgctgagctgctggctgcgttcttgggctacgctgccgcccttgtcgaggctgagcccggcccttacgatgacgttctcactctggctttgaccgagttcgagacccgttacctccgcggtaacgacgtccacgctgtggccgctaagcttcaggctgatgaatccgccgtcactactgccgccaaggttaagaaggtggtcaagagctactatgccgcccgtttggctgctaaccgtcccatgaagccatacgagagcgccctgcttcgtgccgtccacgataaggaggctcttgttcacgccatcttcggtggtcagggtaacactgaggactattttgatgagctccgcgagatttacgacatttacaacggagcaattgtcgactttattgagcttgttgctgagaagcttctcagcctgtctcgtgagcaccccgatgcttccaagatttacacaaagggtctggacattttgcgatggcttaagaaccctgagaccactcccgataacgactatctggtgtacgctcccgtcagtgtacctgtcattggagttatccagcttgcccactacgccatcactgcccgagttctgggtctgactcctggtgaccttcgaaactacctggctggtgctaccggtcactcccagggtatggttactgctgtggccattgcttcgtctgactcttgggagtctttctttgaggcctccgtcaaggccatgaccgtcttcttctacattggtctgcgatgccagcagcagtaccctcacacttctctgcctcctagtgtgctggaagactctgttgctgagggagagggaaagccctctcctatgttgtccattcgtgacctgtctaagtcccaggttcagaagtttgtcgacgacactaacaagcatttgcccaaggagaagcacattgtcatttcccttatcaacggtgcccgaaacatggtcgtgaccggtcctcctcaggctctgtacggtctcaacctggccctgcgaaaggcaaaggctcccactggtctcaaccagggtcgagtcccccactcggagcgaaagctgaagttttcttcccgattcctgcctatcacctcgcctttccactctcctttgcttactgacgctactgacgtgattgtcaacgacttgaagactgccaacgtagagtttgctccctcgtcgctgtctattcccgtgtatgacacttttgagggtgctgacctccgtgagtccaagggctccgttgtggcccgtgtcattgagcttattactcaccttcctgtcaactgggaaattgctactcagttctctggaactcacattttggactttggccccggtggtgcttcgggtcttggtctgcttacccaccgtaacaaggagggtactggtgtgcgagtgatcattgctggtgtgctcgatggctccaacactgatgacgagtttggcttcaagcaggagatctttgaccgcgaagagggaaccgtcaagtacgccattgactgggtcaaggagttctctcctcagcttgtcaagaccacctctggtgagacttttgtcgacaccaagttctcccgtttgcttggtcgtcctcctatcatggttcctggtatgactcccaccactgtgcgacctgagtttgtgtccgctactctcaacgctggctaccacattgagcttggtggtggtggttacttcatgccttccatgctcactgccgctctggagaagattgagaaggctaccaagcctggtgtgggaatcaccctcaacgtcttgtacgttaaccctgtcatgcttcagtggtgtattcctctgattgagcgtctgcgaaatgacggtttccctattgagggtctgaccattggtgccggagtgccttcggttgaggtcgctaacgagtacattcgcaaccttggtctcaagcacatctcgttcaagcctggtaccgtcgagtctattgctactgccattgccattgctaaggccaaccccactttccccgtggtgatccagtggaccggaggtcgtggaggtggacaccactcgtttgaggacttccactctcccattttgcagatgtacgccaagatccgacgtcagcctaacatcatcctggttggtggttctggattcggttctcacgttgacacttacccttacctcactggtgagtggtccacaaagtactcttaccctcccatgccttacgacggtttcctcatgggttcgcgatgcatggttgccaaggagactttcacttctcccgatgctaagaaggccattgtcgaggctcctggtgtcgaggacaaggactgggaaaagacctacaagggacctaccggtggtgtcatcaccgttctctctgagatgggagagcctattcacaagctggccactcgtggtgtgcttctgtggaaggagcttgatgattctatcttctctctgcctcgtaacaagcgtgtggaggctcttaacgctaagcgagactacattatcaagcgtcttaacgacgacttccagaaggtgtggttcggccgcaacgctgccggcgaggttgtagacctggaggacatgacttacatggaggttgtgtctcgtctggttgacctgctctacgtcaagaaggagagccgatggattgacatttctctgcgcaacttcaccggagatgtcatccgtcgtttggaagagcgattcaccaccgagtctggtaagctttctgttgttcagagcttctctcagctcgatgagcccttcaagatgcttgagcagattgccgaggcctaccccgaggccaagaaccagatcatcaacgcccaggataaggactacttcctgatgctgtctcgtcgtcctactcagaagccagtgccatttgtgcctgtgctggatgataactttgagtggtactttaagaaggactctctatggcagtccgaggaccttgccgctgttgtcggcgaggacgttggccgaacctgtattctgcagggacctgttgctgtccgattctctaacgaggtcaatgttcctattaaggacattctggacagcgtgcacaatggccacattgagctcctgcttaaggatgtgtacaagggcgaccagtccaagatccccgtaattgagtctttcggattcaagcctgctaagagctcttctcagcttctgtccaagaacctgaccagcgtcacctctacgtttgacggtgacaatgaggtgcacaagattgactcttctcccacctcatctgctctgccctctgctgagcagtggctcgacctgttggccggatcccagtccaactggcgccactctttgctttccactaacattattgtccagggcaccaagcaccgacccaacgctattcgtgccattctgtctcctgttcgcggccttcgcgtggagattgctaacgcctccgaccctgagaagaccaagctcactgtgtgggagcctatcaacggtaagctcaccaaggtgattgagatctccaaggtttccaaggatgtgatcaaggttctgctcattgaggagcgcacttctgagcgaaagcctgtggctctggagctcctgtacaactacatgcctgagtgcggatttgcccccatccaggaggtcatgcaggaccgtaacgaccgtattaaggagttctactggaacgcttggttcggatccactgagaactgcaacactgacatcgacatcaccaagccttgggacggtgattccatcactgttgaggcaaagtctgttgctgactttgtgcacgctgttggcaacaacggggaggcttttgtatctcgtcctaacaaggtcatgtatgctcctatggactttgccattgtcaccggatggaaggccatcattcgcgccatcttccccaaggtgattgacggagacattctgcgtctggtgcacctgtctaacggattccgcatgttccctggtgccgagcccctcaaggtaggcgatgtcatctctaccactgcgtcgctcaaggctgtcatgaaccaggccagcggcaagatcgttgaggtttctggtattctgcgacgagatggacagccagtgatggaggtcacttcgcagttcttgtaccgaggagcctacagcgactttgagaacaccttccagaacaaggaggagactcctatggaggtgcagctcaagaccgccaaggacgttgctgttctgtgctctaaggagtggttccaggttgacgactcgtccattgacctgctgggtcagaccctgacgttccgaactcagacttctgttcgtttcaagagcgaaaaggtcttctcgtccgtcaagactaccggtcaggtgctgctggagctgcctactaaggaggtgatccagattgccactgtggactacgaggccggtgagtcgtttggaaaccctgtaattgactacttgcagcgacacggaaagaccattgagcagcccgtgcactttgagaacgctattcctctcaacgttggcactgttctggcctcgcgagctccctcttccaacgagagctacgccaacgtgtctggagactacaaccccattcacgtttcgcgagtgttcgccaagtacgtcaacctggccggcactatcactcacggtatgtactcttctgccgtggtgcgatctctggttgagacctgggccgctgagaacaacatcactcgagtgcgtggtttcaactgtaagtttgtgggcatggttctgcccaacgacgacattgagactaagttggagcacattggcatgattaacggacgaaagatcatcaaggtggagtcgttcaagcgcgagactcaggagcccgtgctggtgggagaggccgaggtcgagcagcccgtgtcctcttacgtgttcaccggacagggatctcaggagcagggtatgggaatggacctgtacgaatcctctccagtcgctcgatcagtatgggatcgtgctgaccgacacttccaggagaactacggatttagcattgtagacattgtcaagaacaaccccaaggagctgacggtgcactttggaggtccccagggacgggccatccgcgacaattacatttccatgatgttcgagtctgtggatgaggaaggaaacatcaagtcggagaagattttcaaggacattactgaggacactgacttttacaccttccgcgctcctaccggtctgctgtctgctacccagttcactcagcccgctcttactctgatggagaaggcttcgttcgaggacatgaagtccaagggtctgattgccgctgacagtccattcgccggacactctctcggagagtactctgcgctgacctctctggccgatgtcatgccaattgagtcgctggtggatgtggtgttctaccgaggaatgaccatgcaggtagcagttcctcgcgatgccgctggccgatccaactacggaatggtggccgtcaacccttcgcgagtgtctgccacctttaacgacactgctctccgatttgtggtggagcacattgctgcccagacaaagtggctgctggagattgtcaactacaatgtcgagaaccagcagtacgttgctgccggagacttgcgtgctctggacactctgaccaacgtgctcaactttgtcaaggttcagaagattaacattgacaagctgctggagacactgccagttgagaaggtcaaggagcatctgagtgaaattgtcactgaggttgccgccaagtcagtggccaaaccccagccaattgacctggagcgaggatacgcggtcattcctctcaagggtatctcggtgcctttccactcgtcgtacctgttgtctggagtcaagccattcaagcgattcctggtcaagaaggttcctcgctcggccgtcaagcctgctagtctgattggcaagtacattcctaaccttactgccaaacctttccagatcacaaaggagtacttccaggaggtctatgacttgaccggaagtgacaagattaagaatattttggacaactgggagaagtatgagtcttcctaa

SEQ ID NO: 57 - protein, 310 aa, Arxula adeninivorans
MVERGPDQWLEQIIKCKYLSENDMKKLCEMVKELLMEESNVQPVQSPVTVCGDIHGQFHDLLELFRVSGGLPDDINYVFLGDFVDRGYFSLETLTLLMCLKAKYPNRLTLVRGNHESRQITQVYGFYEECLTKYGSTTVWKYCCQVFDFLTLAAIIDGKILCVHGGLSPEIRMLDQIRVLSRAQEIPHEGGFCDLVWSDPDDVDTWAVSPRGAGWIFGSRVAREFNHVNGLSLIARAHQLVMEGFKYHFKEKDVVTVWSAPNYCYRCGNVASVMKIEDHDYTPKFSIFNAVPDDTLRASPQKGHRSEYFL

SEQ ID NO: 58 - DNA, 933 bp, Arxula adeninivorans
atggtggaaagaggccccgatcagtggttagagcaaatcataaagtgtaaatacctcagcgaaaatgacatgaaaaagctgtgcgaaatggtcaaggagctcctgatggaggaatccaacgtccagcccgtccagagcccagtgacggtatgcggagatattcacggccagtttcacgatctactagaactatttcgagtgtccggaggactaccagatgacattaactatgtgtttttaggggactttgtggaccgaggatactttagtctcgagacgctcaccttactaatgtgcctgaaggcaaagtaccctaatcgactgactcttgtgcgaggtaaccacgagtcccgccaaatcacccaagtgtatggattttacgaagaatgtttgacaaaatacgggtccacaacggtgtggaaatactgctgtcaggtgtttgattttctcaccctggccgccatcattgacggtaagattctctgtgttcacggaggcttgtcgccggaaattcgcatgcttgatcagatcagagttctatcccgagcccaagagattcctcacgagggtgggttttgtgatttggtatggtctgatcctgatgacgttgatacttgggctgtcagcccccgaggagcaggatggatctttgggtcccgagtggctcgagagtttaatcatgtcaacggcctcagtcttattgcccgggcccatcaattggtcatggaagggttcaagtatcatttcaaggaaaaggacgttgtgaccgtgtggtcagctccaaactactgttatcggtgtggtaacgttgcatcagtcatgaaaattgaggaccatgactacacgccaaagttttcgatctttaacgctgttcctgacgataccttacgagcatctccacaaaaggggcaccgctctgaatactttttgtga

SEQ ID NO: 59 - protein, 772 aa, Arxula adeninivorans
MDDPPSVSQAVSVDDDETFHNTTFALKRTRSLGVLDEFQRPKEPAQTKEDFPHLEVADESEMGTSVGSSLSGMNNDHDVASPTTLSSGEDYFSHRSPANSQYYEHGDDDYDHSVSLSPSIPESPDVPQPIDDIAVKPEPSKRVDYFTHNWNESDISASWRYIVLRRKDVANSARLENASWRSWTKAKYNLKTVAPETVNWLKDSDVTWLYGPLYEPPRASESRGRKLSSNSPRSGPSSSADKDRSKPSPPVTKPILKKKSASQMMLSGPGLSSYYTQGPHHSHHPPQVVSPGSTNLHHQENAPTGDVHQGPATAEALLDDNCDSATDIYLRHHNYRTRPRMGGHSNEDLSRYVNRQYRHVPGHLAKPPPGSPGPLSPEEAASASSSSLSLSTRGAGRHIHFNDRVEQCRAVDITESESEDDGDDDDDEDEDDNNNRHRESAISDESEASDSEDDSEDEAGLFLMVRSSSSASLHKKNTLGPLSSNQGKESPHTIELLPATTLKYDYDDSEREARQRDQAHSVAYAMSHNTVNRRHVYKTYDYSSVYQSPTETPHSSPKDSSTESLPDMRFSRRDGINNNENVPSPPQPQPQQQQQPQEKQKQDTEYHSEARGNYDNVTPTQVVLDRGDTSTPPPMSPSAGTHSTHTTTEYAVGQIGPVSKQQSCASSLLMDQRGGSEFVEFAEDAGSPSSKDTTSNADTQGWDAKEGSSGIGRSVSLPSVLGRSASDPGRNHSSSQLNQQQHHQERDGHSRFNAMSAAKGLASVFKGGWKRS

SEQ ID NO: 60 - DNA, 2319 bp, Arxula adeninivorans
atggacgacccgcccagtgtatcccaggccgtgagtgtggatgacgatgagacgttccataatactacttttgccctcaaacggacaaggtcattaggagttttggatgagtttcagcggccaaaggagcctgctcagacaaaggaagacttcccccatcttgaggtggcggatgagtcggaaatgggcactagcgttggctcgtcattgtcgggcatgaataatgatcacgatgtggcatcgcctacgaccttgtctagtggcgaggactactttagccatcgatctccggccaattcccagtattacgagcatggagatgatgactacgatcattcggtttcattgtccccgtcaatacccgagtcgcctgacgtgcctcagcccattgatgacatcgccgtcaagccagagccttccaaacgagtagactattttacccacaattggaacgagtctgatatttctgcatcctggcggtatattgtgcttcgacggaaagatgtggcaaactctgcccgattagaaaatgcttcgtggcggtcatggacaaaggcaaagtataatctcaaaacggtagcccctgaaactgtaaactggctcaaggactctgatgttacttggctgtatggtccgctatatgaaccaccaagagcatctgaatctcgaggccgcaaactgagttcaaattcgccccgctctgggccttcttctagtgctgataaggaccggtcaaagcccagtcctcctgtaacaaagcccattctcaaaaagaagagtgcgtcgcagatgatgttgtccggtcctggcttgtcttcgtactacacccagggtcctcatcatagtcaccatcccccccaggttgtttcgccagggtctactaaccttcaccatcaagaaaatgcacccaccggcgatgtgcatcagggccctgcaactgctgaggcccttttggatgacaactgcgattctgcaacggacatttacctacgacatcacaactatagaactcgtccgcgtatgggaggccattctaatgaggacctctctcgctacgttaaccgccagtatcgtcatgtcccaggccatttggctaagccgcctcctggtagccctggtcctctttcccccgaagaggccgcttctgcctcctcatcctcgctctcacttagcactcgaggtgccggccgtcacatccactttaatgatcgagtggagcagtgccgagcagtcgatattactgagtctgaatctgaagatgacggtgatgacgacgacgatgaggatgaagatgataataataatcgccacagggaaagcgccatctctgacgagtctgaggcttctgattctgaagacgattctgaagatgaagcgggtcttttccttatggttagatcctcttcatccgcttccctccacaagaagaataccttgggacctctcagcagcaaccaaggaaaggaatctccgcatacaattgaattgttacctgccactacgttgaaatatgactatgatgattctgagcgtgaggcccgtcagcgagaccaagctcactcggttgcttatgcaatgagccataacactgtgaaccgtcgccatgtttacaagacatacgactatagttcggtgtatcagtctcctactgagacccctcacagctctcccaaggattcatcgacagagtccctacctgacatgcgcttttctcgtcgtgatggtatcaataacaatgaaaacgttccttcaccaccacaacctcaaccacaacaacaacaacaaccacaagagaaacaaaaacaagatactgaataccactctgaggcaaggggtaattatgacaatgttacccctactcaggtggtcttggatagaggcgatacttccactcctccaccaatgtctccttccgctggaacccacagcactcatactactaccgaatacgctgtcggccaaattggccctgtttcaaaacagcaatcttgtgctagcagtcttttaatggaccaacgcggagggtcagagtttgtagaatttgctgaagatgctggcagccccagctctaaggatacaacttcaaacgccgacactcagggttgggacgctaaagaaggctcttccggaattggtcgcagcgtgtcacttcctagtgtcctcggcaggtctgcgtcggaccccggccgcaatcacagctcctctcagctaaaccaacagcagcaccatcaggaacgggatggccattccagatttaatgccatgagtgctgccaaaggattggcttctgtattcaaaggaggatggaagcgatcatga

SEQ ID NO: 61 - protein, 825 aa, Arxula adeninivorans
MAFWRIGNGFSSISGIDKILDRPDRTLAELLDEQDLLQELHSPNTKLIDFLRTPEIMSEMIDIILDRQSNDTAHKDTSAGSEKGNEMDTSGDSEEEEAEQNKQNDQGDDSESILNVKKRVGLLRSTSSDGDNKDDEFGDQEHNNDQDNRNRDDNDDHDDDDDDDDDDDDDDDEEEEDTAHRHAQLCSEILSADVWSITEALMSNSDYLDSLWSILDFSAPLDVSHASYFTKISEHLLDKKTDEMLNYIRGQRNFVERFMHHIDNPPVMDFLLKVISTDKPENSTGIIDFLQVQQLIPSLITFLGPDVGPAVQSAAGDFLKAFVTISANSNTDANTIGPNELSRELVSERVVRELVRLMLYGGTGLATGVGVVIEIIRKNNSDYDFVPIMCVTMESHPPGPRDPIYLGTLVKVFAEHIPQFQAMLTRAHTDRLKTPFGEVEPLGFERFKICELFAELLHCSNMALLNDENGESVVRSRDQERERVKRVIARARGDMFDEQHDDNNNADEDAIKTDDQDSAPETKEPIESGIQKLDIDAEKQNAGKDSPVVERFGSIELAQEEAKLRQESVAGDLLKIALIDNDCVVTILKMFFQFPWNNFLHNVVYDIIQQILNGPMKEGYNRFLAIDLFGKGRLTRAICDGHKKCEEYEKENNARLGYMGHLTLISEEVVKFTAVFPPESISPVVSQAVTDDEWITYVTDTLVRTREQYNLILGGQRPEEASDIVRSNPNAIILKDAEYQDDLDHDDDDEEVGSEFGEELHHSLPSSDTRVRIDDDDDDHDDDHDDHDDDDDDDHVGHLYDKHQSHGDDDDYDYEDWASSHDTND

SEQ ID NO: 62 - DNA, 2478 bp, Arxula adeninivorans
atggcattttggcgaataggtaatgggttttcgtccatatccgggatcgataagattctggacaggccagaccggaccttggcggaactgcttgatgagcaagacttgttacaggagcttcactctcctaataccaagctgattgatttcctgcgcacgccagagatcatgtccgagatgattgatataattctggaccgacagtccaatgacactgcgcacaaggacaccagcgctggttctgaaaagggtaatgaaatggacacgtccggcgactctgaggaggaagaagcagagcagaataaacagaatgatcaaggcgatgattcggaaagcattctaaacgtcaagaagagagtgggactactgcgctccacaagctctgatggcgacaacaaggacgatgagttcggggatcaagagcataacaacgaccaagacaatcggaaccgtgacgacaatgacgatcatgacgacgacgacgatgacgacgatgatgatgatgatgacgatgacgaggaggaggaagacactgctcaccgtcacgctcagctttgttcagagattctgtcggccgatgtgtggtccatcaccgaagctttaatgtccaattccgactacttggattctctgtggagcatactagacttttctgcgcccttggatgtgtcccatgcatcgtactttaccaagattagtgagcatctgttggacaagaagactgatgaaatgctaaactatatccgaggtcagcgcaactttgtggagcggttcatgcaccacatcgataatccgcccgttatggactttttgcttaaggtcatttctaccgacaagcctgagaattctacgggaattattgactttttgcaggtccagcagctaatcccatctttgatcacctttttaggtcccgatgttggccccgcggtgcagtcggccgctggtgacttcctcaaggcgtttgtcaccatctcggcaaactcaaacactgatgcaaacaccattggtcccaacgagctctccagagaactggtgagtgagcgggtggttagggagcttgtgcgactaatgctatacgggggcactggcttggctaccggagtgggtgtggtgattgagattattcgaaaaaacaactcggactacgactttgtccccataatgtgcgtgactatggagtcccaccctcctggtccaagagacccaatctacttgggtactctggtcaaggtatttgccgagcatattcctcagttccaggccatgctcactcgcgctcacactgaccggctcaagaccccctttggagaggtggagcccttgggttttgaaagatttaagatttgtgagctgtttgccgaactgctccactgtagtaacatggctttgctcaacgatgagaatggcgaatctgtagtacgatcgcgggaccaagagcgagagcgggtcaagcgagtgattgcgcgagctcgtggagatatgtttgatgagcagcatgacgacaataacaatgccgacgaggatgccatcaagaccgatgatcaagattcagcccccgaaacgaaggaacctattgaatcgggcattcaaaagttagacatagacgccgaaaagcaaaatgctggcaaagacagccccgtggtcgaacggtttggaagcatagagctcgcccaagaagaggctaagctccgacaggaatcagtggctggggacctgctcaagattgccctgattgataatgattgtgtggttaccattttgaaaatgttcttccagttcccttggaacaactttttgcataacgtggtttatgacattatccagcagattctcaatggcccaatgaaagaaggctacaatcgattcctggccattgacttgtttggaaagggccggctcactagggccatctgcgacggtcacaagaagtgcgaagaatacgaaaaggagaacaacgctcgattgggctacatgggccatttgacattgatctctgaagaggttgtcaagttcacggccgttttccctcctgagagtatttctcccgtagtgtctcaagctgtcaccgatgacgagtggatcacctatgtcactgatactttggtcagaacccgagagcaatataacctcattctgggtggccagcgtcccgaggaagctagcgacattgtgcgctccaatcccaacgcaattatcctcaaagacgcagagtaccaggatgatctggaccacgacgacgacgatgaggaagttggatcggaatttggtgaagaacttcaccattctcttccttcttcggataccagggttcgcattgatgatgacgacgatgaccatgatgatgaccatgacgaccatgatgacgatgatgatgatgaccatgtgggccacctctacgataagcaccagtctcatggcgacgacgatgattatgactatgaagattgggcatcttcgcatgacacaaacgattga

SEQ ID NO: 63 - protein, 239 aa, Arxula adeninivorans
MLLVGLTGGIATGKSTTSRILRERYGAPIVDADVIAREVVEPGTSAYKKIVARFAKDAPDLLLDDGSLNRPVLGRLVFGPENESARKDLNSIVHPAVRWEMARQVLVAWAIGHRMVILDVPLLFESKLDRFVGTSMAVVCSDKVELERLLARDSFLDKEDAEKRIASQMSLDEKRRLADHVIENDGGLEELEGQIDAVIRKIRPSAAWTFIEWVLPPVGLVSALYYFVTRNYYKPKAKL

SEQ ID NO: 64 - DNA, 720 bp, Arxula adeninivorans
atgctgttagttggactgactggaggtattgctacgggaaagagcacgacgtcgcgaattctcagagagaggtacggagcacctattgtagatgccgatgttattgcccgcgaagtggttgagcctggcacttcggcgtacaagaagattgtagcaaggttcgctaaagacgcacccgacttgctgctggacgatggatcgctgaaccgaccagttctgggacggttggtatttggacccgagaatgagtcggctcgtaaggacctcaattccatcgttcatcctgcagtgcgatgggagatggctcgccaggtgctggtagcttgggctatcgggcaccgaatggtcatcttggacgttcctttactgtttgaaagtaagctagaccggtttgtgggcacgtcgatggcggtagtatgttctgataaggttgagctggagcgattgctggccagagactcattcctggacaaggaagacgccgagaaacgaattgccagccaaatgtctttagacgaaaagagacggttggccgatcacgtaattgagaatgatggaggactagaagagctcgagggtcagattgacgctgtgattaggaagatccgacccagcgcagcgtggacatttattgaatgggttctgccaccagtgggactggtgagtgctctgtactattttgtcacgagaaactactacaaaccaaaggcaaagctatag

SEQ ID NO: 65 - protein, 326 aa, Arxula adeninivorans
MLSPSPEISEFPLPDLYADVVEAEDGGNVSNVSVSPAQVSGDGGAPGASSAAGGGGTVRVKEEDEGDHDSDDDDGKSMSRDSLSMSPGPGGSSGGEKKKGTKRQKEDMKLPLPPGALPPRKRAKTEDEKEQRRVERILRNRQAAHASREKKRKHVEDLERKCVTLTSENDQLQKQVAEAKQSQVQMLEQQYLLMARLQEYQSIVKAVKTSGDLSALDRLDETPAITNIPALTASSPGPSDGSQSSIASPASIKEEYASPESLVLSSFTAPSSPLSLDTPEIKVEPADESSSFLLSTSFHDQAHHPAAVVFRGLSNLLRLATSSVGL

SEQ ID NO: 66 - DNA, 981 bp, Arxula adeninivorans
atgttgtctcctagtccagagatttctgaatttcctctgccagatctgtacgcagacgtggttgaggccgaggacggtggtaacgtttcgaacgtttcggtgtcgcctgctcaggtgagtggcgacggtggcgcaccgggtgcctctagtgccgctggtggcggtggcaccgttcgggtcaaggaagaagacgagggcgaccacgacagtgacgacgacgatggaaagagtatgtcgcgcgacagtctaagtatgagcccgggtcctggaggcagcagtggcggcgaaaagaagaaaggtaccaaacgacaaaaggaagacatgaagcttccactccctccgggagcgttgccgcctcgcaagcgagcaaagacggaggacgaaaaggagcagcgtcgggtggagcgcattctgcgcaaccgacaggcggcgcacgcgtcgcgagaaaagaagagaaaacatgtggaagatttggagcgcaagtgcgtaactctgacgtcggaaaacgaccagcttcagaagcaggttgccgaggccaaacagtcgcaggtgcaaatgctggagcagcagtacctgctcatggcaagattacaagagtaccagtctattgtcaaggcggtcaagacgtccggggacctgagtgccctggaccgtctggacgagacgccggccattaccaacattcccgcgctgacggcgtcgtctcccggcccgtcggacggaagtcagtcatcgattgcatctccggcatccatcaaggaggagtatgcgtcgccagagtcgctggtgctgtcgtcgtttacggcccccagctcgcctctgtcgctggatactccggagattaaggtggaaccagcagacgagagttcgtcgtttcttctgtccacttcgtttcatgaccaggcgcatcacccagcagcggtggtgttccgggggctcagcaacctgctgagacttgcgaccagcagcgtcggtctttga

SEQ ID NO: 67 - protein, 754 aa, Arxula adeninivorans
MPDGAQSWKMIKAPGSQNGRIAQACDRCRSKKIKCDGKRPNCSQCLAVGFECKISDKLTRRAFPRGYTESLEDRVRQLEFENNKLVNLLDLKDEQLEMMSKVHDFDKTGKEQGPPPASAAPTQPQTHSVDPNVCTPPQDDDEEYLVRQIDRLVAHDQYRGSSAGGIFIDALIDKLKMRAPEAVMPIANTFATAYSPGPNSWASSAPDHQSKIIPGSRLTCDKVITTYFQEWHSMYNIVDEQDLLKKYEQCMNNGGSVDHDPLLGVTIALVLAIGSLSTSSPASANEYTAVWKQWFTPELQCGIPSLDTVRALNLALLYSLHVGAVNDIWHFRMMAVNASYRLGLHRCPMSLRRMTAAEPFSIAEQNARRRAFWVTYALDAFSSAALGSPRLLLNESITTKLQSCEEDEDLEPCQLAWMSFSRLLASIVDAFYASAHDQKHCSYKTIIKFEDQLETWKRELPSSLKFELNNGVASSTTSSPSATPVHQKSPLLLMMYHYARILIHMPASAPVDVHSTKGSGSTVAALQSAKMVLQVLLYLHQRKVLSTLCINPSRLVMCLSSVVLYSAVDYSKGGALMQEAKGLVSNCLKYLQGAHEDHVPGALSPESYGWLENGCSIVVGSSSEAQGYRRRRSSGRRSSTGTRPSVSQPSASSSASSVAPSAPITSSSSTDIKIESPATSESSGATSTLSPDVDEMLKYMGFESTLFQNDSNFEKTEYQPAPTAIKEEPRYDNDYMDLWNSFDYSAMLKEEAFV

SEQ ID NO: 68 - DNA, 2265 bp, Arxula adeninivorans
atgcctgacggtgctcagagttggaaaatgataaaggctcctggcagccagaatggccgaatcgcccaggcttgcgatcggtgcaggtccaagaagattaaatgcgacggcaagcggccaaactgctcgcaatgtctggcggtggggtttgagtgcaaaatttccgataagctcacccgaagagccttccccagagggtacacggaatccctggaggatcgagtgcgccagctagaatttgaaaacaacaagctggtgaacctgctagatctcaaggatgagcagctggaaatgatgtcaaaggttcatgattttgacaagactggcaaggaacaaggtcctcctcctgcttctgctgctcccacacagcctcagacccattcggttgacccgaacgtgtgcacccctccccaggatgacgatgaagaatatctggtgcgccagattgaccggttagtggcccacgatcagtaccgaggttcctctgctggtggcatttttattgatgctctcatcgacaagctcaagatgcgtgctcccgaggcagtcatgcctattgcaaatacttttgctacagcctactctccaggccctaactcttgggcttcgtcagcacctgaccaccagtccaagattattcctggctcccgcctgacctgtgacaaggtcatcaccacctatttccaggaatggcactcaatgtacaatattgtagacgagcaggacctcctgaaaaagtatgagcagtgcatgaacaacgggggctcggtagaccacgatcccttgttgggagtcacaattgccctggttctggctattggctctctgagcacgtcgtctcccgcctcggcaaatgagtatactgcagtgtggaagcagtggttcactcctgagctgcagtgcggaatccccagcctcgacacggtgcgagctctcaaccttgctctgctgtactctctgcacgtgggcgccgtaaacgacatctggcactttagaatgatggctgtcaacgcttcgtaccgtctgggactgcatcgatgccccatgtcgcttcgacgaatgactgctgctgaacccttctccattgcagagcaaaatgctcgtcgcagagccttctgggtcacttatgcactggacgcctttagctcggccgctctgggctctccccgactgcttctcaacgagtccatcactactaagctgcaatcgtgtgaagaagatgaggatctggaaccatgccagcttgcttggatgtccttctctcgtctcctggcctctatcgtcgacgccttttatgcctcggctcatgaccagaagcactgctcgtacaagactattatcaagtttgaggaccagctcgagacttggaagcgcgagctcccttcatctctaaagtttgagctcaacaacggagttgcgtcgtccactacctcgtcccctagtgccacgcctgttcaccaaaagtctccgttgctgctcatgatgtaccactatgctcgcattctcatccacatgcccgccagtgctcctgtcgatgttcattctaccaagggcagtggctcaactgtggccgctctccagtccgcaaagatggtgctgcaggtgctgttgtacctccaccagcgaaaggtcttgtcgaccctgtgcatcaatccttcgcgcctagtcatgtgcctgagctcagtggttctgtactcggctgtcgactactccaagggtggtgctctcatgcaagaagcaaaaggccttgtgtccaactgcctcaagtatctgcagggcgcacatgaggatcacgtccctggtgctctgtcgcccgaatcctatggctggctggagaatggctgctccattgttgtcgggtcgtctagtgaagctcagggataccgccgacgaagatcgagcggacgacggtcgtcgactggtacacgcccatcagtgtcccagccttcggcgtcgtcgtcagcgtcatcggtggctccaagtgctcctatcactagctcgtcgtcgactgatatcaagattgagagccctgccaccagcgaaagctcgggtgctacttcaactctgagtcctgatgtggatgaaatgttaaagtacatgggctttgagtcgaccttgttccagaatgacagcaactttgagaagactgagtaccagcctgcaccgactgccataaaggaggagccaagatatgacaacgactacatggacttgtggaattcgtttgattattctgccatgctcaaggaggaagcgtttgtatga

SEQ ID NO: 69 - protein, 381 aa, Arxula adeninivorans
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGN

SEQ ID NO: 70 - DNA, 1146 bp, Arxula adeninivorans
atgcaaatctttgtgaagaccttgactggaaagactatcaccctagaggttgagtcttccgacactatcgataacgtaaagtccaagattcaggacaaggagggtattcctcctgaccagcagcgacttatctttgctggaaagcagcttgaagacggacgaaccctttctgactacaacattcagaaggagtctacccttcacctggtcctgcgtctgcgaggaggtatgcagatcttcgtaaagaccctaactggaaagaccattactcttgaggtcgagtcttccgacactattgacaacgtcaagagcaagattcaggacaaggagggcattcccccagaccagcagcgactgatttttgccggaaagcagcttgaggacggacgaactctgtccgactacaacatccagaaggagtctacattgcatttggtacttcgtctgcgaggaggtatgcagatttttgtcaagactctgactggaaagactatcacccttgaggtcgagtcctctgatactattgacaacgtcaagagcaagattcaggataaggagggcattcctcctgatcagcagcgactcattttcgctggaaagcagcttgaggacggacgaaccctctctgactacaacattcagaaggagtctacccttcaccttgtcctgcgtctgcgaggaggtatgcagattttcgtaaagactcttaccggaaagaccatcaccttggaggttgagtcttctgacactatcgacaatgtaaagtccaagatccaggacaaggagggtattcctccagaccagcagcgactgattttcgccggaaagcagctcgaggatggtcgaactttgtcggattataacattcagaaggagtccactctccacctggtcctgcgtctgcgaggaggtatgcaaatcttcgttaagaccctaactggaaagaccattactcttgaggttgagtcctctgatactatcgacaacgtcaagagcaagattcaggacaaggagggcattcccccagaccagcagcgactcattttcgctggaaagcagcttgaggacggccgaaccctctctgactacaacattcagaaggagtcgactctccaccttgtgctgcgcctgcgaggaggcaactaa

SEQ ID NO: 71 - protein, 331 aa, Arxula adeninivorans
MTKLSYVGRPPTDIFQWPVGLAMPSGPFGSWFETMMDVRVPLTVASVYATTVHVLNHFRKTNKEPIGLAKTRLFQWLVVAHNMGLCVYSAWTCYGMSAAIYQSVFEVTKVAVGNTERGTVDAYLRGEGSLVDGTSGNATAGFWRALCDVDVGIWDHGLSYYGFFFYLSKFYEVVDTLIILAKGKQSSLLQTYHHAGAMLSMWAGIRFASPPIWIFVVFNSLIHTIMYFYYTLTTLKLRVPTVVKRSLTTAQICQFVFGGSFALLHMFVYYFDPNTQSYSSCLSDPGQGFALMFNVAYLAPLTYLFVNFWIDSYVRSKQRAADRKAAAKAKQ

SEQ ID NO: 72 - DNA, 996 bp, Arxula adeninivorans
atgaccaagctgtcgtacgtgggacgcccgccaactgacatttttcaatggccagtaggcctggcaatgccatccggtccgtttggatcttggttcgagactatgatggatgtacgagtgccgttgacggttgcctctgtgtacgctacaactgttcatgtgctgaaccatttccgaaagaccaacaaggagcccattggcctggcaaagactcgattgttccagtggttggtcgtggcccacaacatgggcctgtgtgtttactctgcctggacttgttatggtatgtctgcagcaatttaccagtctgtgtttgaggtgaccaaggtagcagtcggaaacactgagcgtggtactgttgatgcgtacctgcgtggagagggtagtctggtcgatggaaccagcggtaacgctactgccggattctggcgagccttgtgcgatgtcgatgttggtatctgggaccacggactgtcctactatggatttttcttctatctttcaaagttttacgaggtggtcgacactctgatcattctggccaagggtaagcagtcgtctcttcttcagacttatcaccacgccggtgctatgttgtccatgtgggctggaattcgattcgcttcccctcccatttggatctttgtggtgttcaattctctcattcacaccatcatgtatttctactacaccttgaccacccttaagctgcgcgttcctaccgtggtgaagcgcagtttgaccaccgcccagatttgccaattcgtcttcggtggttcgtttgcactgctgcacatgtttgtgtactattttgatcccaacacccaatcgtactcatcctgtctgtccgatccgggccaaggatttgccctcatgttcaatgtagcctatctggccccattgacttatctattcgtcaacttttggattgacagttacgtgcgaagcaagcagcgggccgccgaccgcaaagctgcggcaaaggcaaagcagtaa

SEQ ID NO: 73 - protein, 310 aa, Arxula adeninivorans
MTDKHRFPFAFAPDIIRANQKDAYIESTLKESIETVLRKWKGSRFVHSHGPQVSSGTSFLYLALTTLLGARTLGEEYCDIFYVNRKGDLPSWTRRAGYVVTSALGPIVVARLLQKLKVRLQVANQRAQARDPAAASSLKSRLYSLLQSVADTPSIQGLLTIHLAIFYFYGSYYQFTKRIWGLRYAFGHQINPLEFRGGYEILGVLIVAQYLFRGASYSLERMGPDQESVKPLSASHINNVQLDLSDPTVLAYIPEVSRKCTLCLEYMKDPTATVCGHTFCWTCACEWTREKPECPLCRQPCQEQNLLPLR

SEQ ID NO: 74 - DNA, 933 bp, Arxula adeninivorans
atgacggacaagcatcggtttccgtttgcgtttgcccccgacattattcgggctaaccagaaggatgcatatatcgaatcgacgctcaaggaatccatagagactgtattgcgcaagtggaaaggatcaaggtttgttcattcgcatggtcctcaggtgtcgtcgggcacatcgtttttatacctggcactgacgaccttgctgggagctcggactctgggtgaggagtattgtgatatattctatgtgaatcgtaaaggagacttaccatcatggactcgtagggcaggctatgtggtgactagtgcactgggcccgattgtggtggctcggttactgcaaaagctgaaggttcgactacaggttgcaaaccagcgagctcaggctcgagatccagcagcagcgagttcactaaagtctcgactgtatagcctgctgcaaagtgtcgccgacaccccgtctatccagggactgctgacaattcacctggcaatcttttacttttacggttcatactaccagttcactaagcgaatatggggcctgcggtatgcttttggacatcagatcaatcccctcgagtttcgtgggggctatgaaattctcggagtgttaattgtagctcagtacttgttccgaggtgcttcatactcactagaacgaatgggccctgaccaggaatcggtcaagcccctgtcggcgtcccatattaacaatgtccaactggacttgtcagatcctactgtattggcatatattcctgaagtgtcccgcaagtgcaccttgtgtctggaatacatgaaggatcctactgccacagtttgcggacataccttttgctggacatgtgcatgcgaatggacccgggaaaagcctgagtgtccactatgcagacagccatgtcaagagcagaacctgctgccccttcgataa

SEQ ID NO: 75 - protein, 470 aa, Arxula adeninivorans
MSAALLTQRVTVARGFMRYASRCKVATPYVARFYASKSWPEHQVINMPALSPTMTSGNIGTWQKKVGDKLSPGEALVEIETDKATMDFEFQEEGFLAKVLLETGEKEVPVGQPIGVYVEEESDVQAFADFTLADAAPEGGVKQEKPAEGAKEESSAEPAKEESSAEPAKEQQPSKPAKEPEFGDRIVASPIAKTIALEKGIPLREIKGSGPNGRIIKRDVENWKPAAAAAAAPAAGAQYEDIPISMMRKTIANRLTQSKQTSPDYIVSSTVSVSKLLKLRASLNAVAEDRYKLSVNDILVKAVAAACKAVPAVNSAWLDKEGVIRQYKNVDVSIAVATPTGLITPVVRNADAKGLAAISTEAKALGKKARDNKLQPEEYQGGTITISNMGMNHAVTMFTAIVNPPHSAILAVGTVERRAIEDPESETGIAFDDVMTVTGTFDHKVVDGAVGGEWMKALKRAIENPLELML

SEQ ID NO: 76 - DNA, 1413 bp, Arxula adeninivorans
atgtcggcggctcttcttacacagcgagtcactgtggctcgtgggttcatgcgctacgcttctcgatgcaaggtagctaccccctacgttgcccgattctacgcttccaagtcgtggcctgagcaccaggttatcaacatgcctgctctttctcctaccatgacttccggaaacatcggtacctggcaaaagaaggtcggtgacaagctcagccctggtgaggccctggtagagattgagaccgacaaggctaccatggactttgagttccaggaggagggtttcctggccaaggttctgctggagaccggagagaaggaagtgcccgtgggtcagcccattggtgtgtacgtcgaggaggagtctgacgtgcaggcttttgccgactttactctggctgacgctgctcccgagggaggtgtcaagcaggaaaagcctgccgagggtgccaaggaggagtcctctgctgaacccgctaaggaggagtcttctgctgaacccgctaaggagcagcagccttctaagcctgctaaggagcctgagtttggtgaccgcattgtagcatcccccattgcaaagaccattgctctggagaagggcattcctctccgcgagatcaagggctctggacccaatggccgcattatcaagcgcgacgttgagaactggaagcctgctgccgctgccgctgccgctcctgctgctggtgcccagtacgaggacattcccatctccatgatgcgaaagaccattgccaaccgtctgacccagtccaagcagaccagccccgactacattgtgtcttcgaccgtgtctgtttccaagcttctcaagctgcgagcctctctcaatgccgtggctgaggaccgttacaagctgtctgtcaacgacattctggtcaaggccgttgctgctgcctgcaaggccgtgcccgccgtcaactctgcttggctcgacaaggagggtgtcatccgtcagtacaagaacgtggatgtgtccattgccgtggccactcctactggtctgatcacccctgtggtccgcaacgccgatgctaagggtctggctgccatctccaccgaggcaaaggctcttggtaagaaggctcgagacaacaagctccagcctgaggagtaccagggtggtaccatcaccatctccaacatgggaatgaaccacgctgtcaccatgttcactgctattgttaacccccctcacagcgccattctggccgttggcaccgtcgagcgacgggccattgaggaccccgagtccgagactggcattgcctttgacgatgtcatgaccgtcactggtactttcgaccacaaggttgtggacggagccgttggaggtgaatggatgaaggccctcaagcgagccattgagaaccctcttgagctcatgctgtaa

SEQ ID NO: 77 - protein, 523 aa, Arxula adeninivorans
MNGDSAAPQKAELPRPYKCPICDKAFHRLEHQTRHIRTHTGEKPHACTFPGCTKKFSRSDELTRHSRIHTNPNSRRNNRKDRDDNSHANANQGNANANNSGNGSPASGAVAGATGVGGAPTRPPLTQSNSMTSLTSLVHASQQAQQAQQQQQQQQQPVYPKSEYSTRNSSPYNSSPSSPVLSHYPQQHQPQQPLPPPQQLQQAQQQQQQQQQQQQQQQQQQQQAQGQFVRVPLSSFSRSALDMNALATAASQELERERRLGPMSTPGSGQSTPASTPSSMLSPSTSAGSSPYASSMRSTQSGGLQSTLSSPALSSYFGQSSSHHLSHFHHPGSSHPLHHVPLTRMAPLTSITGAKGRGDDHDPEGYLGHRAKRSRPNSPVSTAPSSPTFSPSGSPTPDHTPLVTPAHSPRIHPREPGAEMGGLQLPSIRALSLGRNVPPSLQPMEVGSGAPYTQQQLQQQQQQQQQQQQQQQQLQQQQQQQQQQQQQPQQQPQPESAQQPMQQDQQEPTNHNGRLAVSDLINN

SEQ ID NO: 78 - DNA, 1572 bp, Arxula adeninivorans
atgaacggagacagtgctgccccacagaaagctgagctccctaggccttacaagtgcccgatctgcgacaaggcgttccaccgtctggagcaccaaactcgccatattcgtacccataccggagagaaaccccatgcctgtacctttccaggctgtaccaagaagttctctcgatccgatgagctgacccgacactctcgaatccataccaatccaaactcccgtcgtaacaaccgcaaagatcgcgatgataacagccacgctaacgctaaccagggcaatgccaacgcaaacaacagtggcaatggttcccccgccagtggtgctgttgccggagccacaggagttggtggtgcacctactagacctcccttgacccagtccaactccatgacttcgctgacctctttggtgcacgcttctcagcaggcccaacaggcccagcagcagcagcagcaacagcagcagccagtgtatccaaagtccgaatactccactcgtaattcttctccttataattcttctccctcttctcccgttctatctcactatcctcagcagcaccagccacagcagccattaccacccccacaacagctccagcaagcacagcagcagcaacaacaacagcaacaacaacaacaacagcagcagcagcaacaacaacaggctcagggccagtttgttagagtgcctctgtcgtcgttttctagatcggctctggatatgaatgctctggccaccgctgcttcgcaggaactggaacgggaacgccgattgggacccatgtccactcctggatcgggccagtctaccccagcgtctacaccctcttctatgctgtctccgtccacgtcggctgggtcgtcgccttatgcgtcgtcaatgcgtagcacccagtctggaggactgcagtcgacgttgagttcgccagcgctgtcgtcgtactttggacaatcgtcgtctcaccacctgagccatttccaccaccctggatcttctcaccctcttcaccacgtcccattaactagaatggcgcccttgacatctattacaggggccaagggccgcggtgacgaccatgatccagaaggatacctgggacaccgagccaagcgatcccgacctaattcgccagtgtccactgcgccgtcatccccaacctttagtccgtcgggatcgccaactcctgatcacactcccttggttactccagctcattcaccccgcattcaccccagagaacctggggccgagatgggtggtctgcagttgccttccattcgggcactcagtcttggtcgtaacgtacctccttcgctgcagcctatggaagtgggatccggagcaccatatacccagcagcagctacagcagcaacagcaacaacagcagcagcagcaacagcagcagcagcaattacaacaacaacagcagcagcagcaacagcagcagcagcaaccccaacaacaaccacagccagaatccgcacagcagccaatgcaacaggatcaacaagagcctaccaaccataatggacgactggcagtgtcggatttgatcaacaattga

SEQ ID NO: 79 - protein, 991 aa, Arxula adeninivorans
MNNQPPQKKQKKEDDPPRRRPASSVIGVTRSISACQRCRTRKTRCDQKFPSCTACLRAKVECVGIDAATGREIPRSYVSHLEDRVALLESHLQSFGLDIDSLSHQNVGKVASSGALVPAGGGGSGGSGSGAGSVASSSGRNGSTGAATASSDGPEPKAEEDDVNTDSTTAPASAVHNVIREVPMVPETTPSSSAKQSTFLGQSSGLSFARILMTAVRMRNHDMVSSSERTSVSGNTNGQRHGSGSGGENSASSSKAVDTPKPKPKPAVLPPKETAESYLAAYFSQANPQLPVLHREDFLHKYFEPIYGKLSSKVSLASDYTSMASEVSDDRDPDCYYYKYCHNATDEERERLALGEPRPELYFLNIVFGIATSIHQQQYPAHISESYRLTAMHHCDAVFTAPNRLESLQGILLSALYSVMRPAVPGVWYVLGSALRLCVDLGLHYEGSVRSRVSTSNGLHGGSNFNGSANFDPLTRDMRRRLFWCTFALDRQVCVYLGRPFGIPDESVKVPFPSELDDAMITKERLGTVTDFSKETSTSPSYKTVALSFFRIRLIQSEIQRVLYDCADVPRKYKSLEEWKHDMARKLEEWHHQCPKSTRKMNCNFNIAFFELNYHQTRLLLYGLSPGNTGPTVESYLIIADAGEKIIKKYHELHRKRVINYTWVAVHNLFMSGTSYLYALYHSPEVRANTTLEEIDFNTLACIHVLSSMSDCCDAAVGCRDSFELLTAAIMKLCYNERAGIVMQPLKNVNTITSASGSTAGPGQDGVHLVNQPTSPNDSFSATSPGHSQNFPSGLRAGMTMTRAGYHGVRNNRYIKKEVSSSGEGIAASAGLAPQQPQQHQSQHHHPQQQQQQQPQSDSQQQQQLMAPDEVGPMPWPMPDDLELFFQEAAQLEGISPDSIRTGGASNSPEAASWYGDSTEGPGGVLIDNNRHNVGGRHDQQRIYDIINGVPLAPIWDQFFAPHHVTTPPAPDTTNMEDDKPYSDIFSSRWQ

SEQ ID NO: 80 - DNA, 2976 bp, Arxula adeninivorans
atgaataatcaacctcctcagaagaagcagaaaaaagaagatgacccccctcgaagacgaccggcgtcgtcagtgattggagtaactcggtccatctcggcttgtcaacgatgccgaacccgtaagactcgatgcgatcaaaagtttcccagctgcactgcgtgtttgcgagccaaggtggagtgtgttggaatcgacgctgccaccggtcgagagattccccgatcgtacgtgtcccatcttgaggatcgcgtggcccttctggagtcgcatttgcaaagttttggattagatatagattcactatcccaccagaatgtaggaaaagttgcctcttcaggcgctcttgtgcctgctggaggtggtggtagcggtggctctggcagtggagcgggttcggtagcgtcttcgagcggtagaaatggttctactggtgcagcaactgcttcatcagatggaccagaacccaaggctgaagaagacgacgtcaatactgactccaccacggcccctgcatcggcagttcacaatgtcattcgtgaagtgccaatggtccctgagaccactccaagctcgagcgctaaacaatccaccttcttgggccaatcttctggcctgtcatttgcacgcattctcatgaccgcagtgcgaatgcgaaatcacgacatggtctcctcgtcagagaggacgtctgtgtcgggcaatactaacggacagcgacacggtagtggcagtggcggggaaaactccgcttcgtcctcaaaggctgtagacacgccaaagccaaagccaaagccggctgtgttaccaccaaaggagactgccgaaagctacctggcggcatatttttctcaggcaaacccacagctccccgtccttcaccgcgaagactttttacacaagtattttgagcctatttacggcaagctgtcatcaaaagtctctctagcatctgattatacttctatggcatctgaagtatctgacgatcgcgaccctgactgctactattacaagtactgccacaatgctactgacgaagaacgcgaaagactggctctaggggaaccccgacctgaactgtatttcctcaacattgtgtttggaattgccacttccatccaccaacagcaatatcctgctcacatttctgagagctatcgtctaactgcaatgcaccattgcgatgctgttttcacggcccctaatcgtcttgaatccctgcagggcattctgctatccgcactatattcagtcatgcgtccagcagtgccaggagtatggtatgttctaggttcggctctacgtctatgtgtcgacctgggacttcactacgaaggttcggtgcgatcacgggtcagtacatccaatggcctccacggaggatccaatttcaatggctcggccaatttcgaccccctcaccagagatatgcgtcggcgactattctggtgcacatttgccttagatagacaggtttgtgtgtacctcggcagaccgtttggtatccctgacgaaagtgtcaaggttccattcccgtccgaactcgacgacgcaatgatcacaaaggagcgtctaggaactgtcactgacttttccaaggaaacatccacttcgccttcgtacaagacggtagcgttgtccttcttccggatccgactaattcaatcggaaatccagcgagtgttgtatgactgtgccgatgtgccccgcaaatacaagtctctggaagaatggaaacacgacatggcccgaaaactggaagaatggcaccaccagtgtccaaagtccactcgcaagatgaactgtaatttcaacattgcctttttcgagctcaattatcaccagacccgcctgctgttgtacggacttagtcccggtaacactggtcccacggtcgaatcttacttgataattgcagacgctggcgagaagattattaagaaataccacgaactccatcgcaagcgagttatcaactatacctgggttgcagttcacaacctgttcatgtcgggaacgtcatacctgtacgctctgtaccactctccagaagtgcgagcaaacactactctagaggagattgactttaacactctggcatgcatccatgtattgagttcaatgtccgattgttgcgatgctgcagtaggatgccgtgactcgtttgagcttttaacagcggcaattatgaagctgtgctacaacgagcgggctggaatcgtcatgcagcctcttaagaatgttaatactatcacgagtgcctctgggtccactgctggtccaggtcaggatggcgtccatctggttaaccagcctacctctcctaacgacagcttctcggcgacatcgcctggacactcgcaaaacttcccatctggtctgcgtgccggtatgacaatgacccgagcaggataccatggtgttcgcaataatcgctatattaagaaggaagtcagcagctctggtgaaggaattgctgccagcgcaggcctagctcctcagcaaccacaacagcatcaatcacagcatcatcatcctcagcaacaacagcagcagcaaccgcagtcggactctcagcaacagcagcaactgatggcccccgacgaggtaggaccaatgccatggcccatgcccgacgatttggagctctttttccaggaggctgctcaattggagggtatctcacctgactccattcgtactggcggagcttccaactcgcctgaggctgcttcgtggtatggtgatagcactgagggacccggtggagtgttgatagataataatcgtcataacgttggcggtcggcacgaccagcaacgaatctatgacattatcaatggagtgcccctggctcccatttgggaccagttctttgcacctcatcacgttacaacccctccagcacccgacactactaacatggaagacgacaagccatattcggatatcttttcgtcccgatggcagtaa

SEQ ID NO: 81 - protein, 510 aa, Arxula adeninivorans
MLSTVKHISSRSFARVAPRVAVRTMAINTDNVRPQPDKVLTDIADYVHKYKVDSDVAVETARLCLLDTLGCGLEGLKYKQCANLVGPVVPGTVVPNGTRVPGTDYVLDPVRGAFSIGTIIRWLDYNDCWLAAEWGHPSDNLGGILAVADWQTRTAKATSGKEGKVFKVSDVLDAMIRAHEIQGGLAIENSFNKVGLDHVVLVKVATTAVVSKLLGLSYDQTVDAISHAFVDGQSLRTYRHAPNTMSRKSWAAGDAVSRAVNLALHVRAGEGGMPSVLSAKTWGFYDVLFKGQPFKFQRPYGSYVMENVLFKISFPAEFHAQTAAEAAMILHSKLKDMGKTSDDIKHIKVRTQDAAMRIINKTGPLYNYADRDHCLQYMIAVPLIHGRLTADDYTDEVASDPRIDALRDKMEVVEDTRFSEEYHAPEKRYIGNALQITLNDGTVLDDVEVNYPIGHRKRREEGTPVLLEKFERHLRGRLDEGQVQKIVAASQPDKILDLDIDQYVDLYVKN

SEQ ID NO: 82 - DNA, 1533 bp, Arxula adeninivorans
atgttgtccaccgtaaaacacatttcttctcgttcgtttgctcgagtcgctcctagagtcgcagttcgcacaatggctattaacaccgataacgttcgtcctcagcccgacaaggtgctgactgacattgccgactatgtgcacaagtacaaggtggactctgatgtggctgtggagactgctcgtctgtgtctgttggacactctgggttgtggactggagggtctcaagtacaagcagtgcgccaacctggttggccccgtggtgcctggtactgttgtgcccaatggaacccgagtgcccggaactgactacgtcttggaccctgtgcgaggagccttttccattggaaccatcatccgatggctcgactacaacgactgttggttggctgccgaatggggacacccttcggacaacctgggaggtatcctggccgtggctgactggcagacccgtaccgcaaaggccacctccggcaaggagggcaaggtgttcaaggtcagcgacgttctggacgctatgatccgcgcccacgagattcagggtggtctggccattgagaactcgttcaacaaggtcggtctcgaccacgttgtgctggtcaaggttgctaccaccgccgttgtttccaagcttctgggtctgtcgtacgaccagactgtggacgcaatctcccacgcctttgtagacggacagtctctgcgaacctaccgacacgctcctaacaccatgtcgcgaaagtcgtgggctgccggagacgcggtgtcgcgagctgtcaaccttgctctgcacgtgcgtgctggcgagggtggaatgccttcggtcttgtcggccaagacctggggtttctacgacgtgctgttcaagggccagcccttcaagttccagcgcccttacggctcctacgtgatggagaacgtgctgttcaagatctccttccctgctgagttccacgctcagaccgctgctgaggctgccatgatcctgcactccaagctcaaggacatgggcaagacctcggacgacattaagcacattaaggtccgaacccaggacgctgctatgcgaatcattaacaagactggtcctctgtacaactacgctgaccgtgaccactgtctgcagtacatgattgctgtgcctctgatccacggacgattgaccgccgatgactacactgacgaggttgcctctgaccctcgcattgatgctcttcgtgacaagatggaggttgtcgaggacacccgattcagtgaggagtaccacgctcccgaaaagcgatacattggtaatgccctccagattaccctcaacgacggaactgtgcttgacgatgttgaggtcaactaccccattggacaccgcaagcgacgtgaggagggaactcccgttctgctcgagaagtttgagcgtcacctccgcggccgtctcgacgagggccaggtccagaagattgtcgctgcctcccagcccgacaagattctcgacctcgacattgaccagtacgtcgacctctacgtcaagaactaa

SEQ ID NO: 83 - protein, 2494 aa, Arxula adeninivorans
MVPSLEEIHESELYQIAQASWLDREESVDDVTRVVAEIWSALTKTNFGESSVLILEQSKAFESILFPSFSEDSSDEHTILTVLVANSKLARGLPLWDLVERDPDVFESLFNRVVALALPGNADDGIINDHRAHLILFVTACFYHLELAVIRKLIGPLISISIWTHLEAKVREGILSEHPSLAKAWKRSQKKLQSANQEKKQEMVLQSDWIYSLLSSLHKVNDPLCKRAYVHLLIAIASQLPTRRYPNTLFKQLQVLPILRLSYKDQADVVDILENYMYFSIDDYSGEPLTEVEVWERHSKEVRTLQQVAFSQFREKLHLLALTNFDSIHHRPELEEHLAPLDLDELKSLADAVGISTDRLGMEATRELVVECFVQKYKQRNWKPWLDMDLLPTEKSLFDPIYEYWTRLCRDDKPCLPMGGYNVGSQYLTTDDMLFRSMKVNTVAQFTRIRQDIQYVMDHLQPAVSGGRKRGIDGQHVDSVEKVEFGGYSKRATLIAEGPSIVEKSTPLFGQLYPGKVLVETIIDLGVMPRGDVQEWDRSVTPGSLLCLAKLAAPQNRALDGQQYGIEHIRTARVSKVLDGKGQPIRQEEDDDDTENGFKRRAKKSGEIRKLVLEIDPRGFLDPKEDSVVESLNFVARLPHLQDNAVKSGGVDELPSWLADVVLGFGDPTSASVEARGTEEVDFVDTILDQSHLEECLGEQVSNVERGIAAPYKFSYKLEGPIEVHEGQKVDLKNKIRFNTNQVHAICRGANRGLTLVQGSNGTGKTSVGAQVINVLYHSTKRNKTLLISRTSRALERHLDRLLELGVDIKHMIHLCSEPSSSSSSSKYNGSSYWELRGPLLGKVDLLAKAMAVPGAHGDSCETAEYFYQTHVKPVKDAGKQAPLQDYSWEDVDKLFRDLREIRPLELVKNPEGRQQYFAQTCPVIAMTAHDAIEWRAKLSRWDISFDSAVVVEAGQLSELTTVLTIPNMVSRVVLIGDETHVVPTTTVRDEVDLVLDHGYGVSQSLLSRLVRLGVPKVDLSEVVDPEKSLTLSIPRIPRGHSSGDAVSANSGLGYTFQVIDVTEGVEERMDGVVQNAAEAEYAVWLYQYMRLLGYPACTIAIVTATHGQRQLVQDIVDTRARGTIVDREIFGAPGLIATVHEYQGVSHDYVICSTVFTRTPFDYRTQHRQQAVRGALAGARKGLYVLSRKEVIQATELKDFVVESPDNKLAVVPRELYGKSRRQWNDCTGAVTMENVDHLGMAASRTSTTTLSRSLSGASMQGGAAGDNGGPDHKYNNLQLAPNRYQTQLVEEASAMSEGNRSKGVHDIRASSNLLGSMNKILVANRGEIPIRIFRTAHELSMQTVAIYAHEDILSMHRLKADEAYVIGEVGQYSPVQAYLQSDEIIKIAKAHGVNMIHPGYGFLSENSEFAKKVEEAGIAWVGPPPQVIDSVGDKVSARQLAIKCDVPVVPGTPGPIDDVQEAKQFVEKYGYPVIIKAAFGGGGRGMRVVREGEDIVDAFNRAVSEAKTAFGNGTVFIERFLNKPKHIEVQLLADGEGNVIHLFERDCSVQRRHQKVVEIAPAIDLPVEVRDNILKDAVKLAKTANYRNAGTAEFLVDDQNRHYFIEINPRIQVEHTITEEITGIDIVAAQIQIAAGATLEQLGLTQDRISIRGCAIQCRITTEDPSKGFQPDTGKIEVYRSTGGNGVRLDGGNGFAGAVISPYYDSMLVKCSCLGSNYEIARRKMLRSLVEFRIRGVKTNIPFLLKLLTHETFIAGKCWTTFIDDTPSLFDMLHSQNRAQKLLSYLADIFVNGSQIKGQIGLPKLKGHPTVPQLKDNSGKVVDVTTPPTEGWRKVLVEEGPDAFAKKIRAHKGALIMDTTWRDAHQSLLATRVRTHDLLRIAPTTAHALSGAFALECWGGATFDVAMRFLHEDPWDRLRKLRKAVPNIPFQMLLRGANGVAYSSLPDNAIEHFCKQAKDNGVDIFRVFDALNDLEQLRVGVDAVKKAGGVVEATICYSGDMLNPSKKYNLQYYLNMADEVVKMGTHILGIKDMAGTMKPAAATKLIGALRERYPDLPIHVHTHDSAGTGVASMTAAALAGADAVDAASNSMSGMTSQPSISALVASLQGSLDTGLNPSYLREIDSYWAQMRLLYSPFEADLKGPDPEVYEHEIPGGQLTNLIFQAQQVGLGAQWAETKKTYEQANELLGDIVKVTPTSKVVGDLAQFMVSNKLTPKDVEERANELDFPGSVLDFFQGLMGFPYGGFPEPLRSKVLEGKREKFTERPGKTLPPLNFDELRADLEKRFGSITECDIASYNMYPKVFEDYRKTLEKYGDLSVLPTQYFLAPPEIGKEFSVEIDQGKILVLKCVAVGDLSLQTGTREVYFEVNGEMRNVTVEDRTAAVETVTRAKADAHNPNEIGAPMAGMVVEVRVQEGSEVKKGDPVAVLSAMKMEMVISAPVSGKVGELLVRAGESVDGNDLLCRIVKPTAHDASQVDIPVGVPMNEGVAPLK

SEQ ID NO: 84 - DNA, 8875 bp, Arxula adeninivorans
atggtaccttcgctagaggagattcacgaatcggaattgtaccaaattgcgcaggctagctggttagacagagaagagtctgtggacgatgttacacgcgtggttgctgaaatttggtcggcgttgaccaagaccaacttcggagaatcttcagttttgattctcgaacagtcaaaagcatttgaaagcattctattcccttcgtttagtgaagattcatctgatgagcacacaatcctgacagttttggtggccaattcgaaactggccaggggcttaccactgtgggatttggttgagagagacccagatgtctttgagagtttatttaacagagtggtggcattggcattgcccgggaacgctgatgacggtatcattaatgaccatcgggcacatctcattctatttgttacagcatgtttctatcacctggaattggcggtgattcgcaaactaattgggccattaatatcaatttcaatttggacgcatctagaggctaaagtcagggaaggcattctgtctgaacacccatcacttgccaaagcctggaaacgatcgcagaagaaactccaatcagctaaccaagaaaagaaacaggaaatggtcctgcagtcggattggatatactcattgctaagttcattgcataaggttaatgacccgctctgtaaaagagcgtacgtccaccttttgatagctattgcatcacaactgcccaccaggcggtaccccaatactctttttaagcagttgcaggtgctcccgattctaagactcagctataaggatcaggctgatgtggtggatattttggagaattacatgtactttagcatagacgactactccggggagcctttgacagaagtggaagtatgggagcgacactcaaaagaggttcggacactgcaacaggttgcattttcgcagttccgagaaaaacttcatctattggcattgactaattttgactctatccatcaccgtccagaactggaggagcacctggcaccgctagatttggatgagctcaagagccttgcggatgctgttggtatttctaccgacagactgggtatggaagccacccgggagcttgtagttgagtgctttgtgcaaaagtacaagcaacggaactggaaaccctggctggatatggatctgcttcccacagaaaaaagtctttttgaccccatttacgaatattggacgagattatgcagagatgacaagccatgtttgccaatgggtggatacaatgttggatcacagtatctcaccacggacgacatgctgtttcgcagcatgaaggtaaacaccgtggcgcaattcactcggatacgccaggatatccagtatgtgatggaccatctgcagccagcggtatccgggggtcggaaacgaggcattgatggtcagcatgtggactctgttgaaaaggtagagtttggtggatacagtaaaagggccaccttaatagcggagggacccagtattgtcgaaaagagcacgccgttgtttggacaattgtatccaggcaaggtattagttgaaactatcattgacctaggagtaatgccgcggggcgatgtacaggaatgggatagatcagtgaccccggggtcgcttttgtgtcttgccaaactggcagcgcctcagaacagagctctggatggacagcaatatggaattgagcatatccgcactgctcgagtcagtaaggtacttgatggcaagggccagcctataagacaggaagaagacgatgatgacactgagaatgggtttaaacgaagagcaaaaaagagtggtgagatccgcaaactagtacttgaaattgacccccgtgggtttttggacccgaaagaagactctgtggttgagagcctcaactttgtggccagactcccccatttacaagacaatgcggtcaaaagtggtggtgtagatgaacttccatcgtggctggccgacgtagtcctgggatttggggaccccaccagcgctagtgtagaggcccgtggaaccgaagaggttgatttcgtggatacaattcttgatcaaagtcatcttgaggagtgcctcggagagcaagtttctaatgttgaaagaggcatcgctgcgccatacaaattctcctataaacttgagggccctatagaggttcacgaaggacaaaaggtggatttgaaaaacaagatccggttcaataccaaccaggtgcatgcaatttgccgtggagccaaccgtgggctaacattggtgcagggcagtaatggaacaggcaagacgtcagttggagcccaggtcattaacgttctttatcattctacgaaaaggaacaaaacgctgctgattagtcgcaccagtcgtgctctggaaaggcatcttgaccgactgctggaactaggggtggacattaagcatatgatccacctgtgctcagagccatcatcatcatcatcatcatcaaaatacaacggatcaagctactgggagcttcgtggccctttacttggcaaggtggaccttttggccaaagcaatggcggtgcccggagctcatggcgacagctgtgagacggcagagtacttttaccaaacgcatgtcaagccagtcaaggacgctggaaagcaagctcctctacaggactacagctgggaagatgtagacaagctatttagagatttgcgagagattcggccgctggaattggtcaaaaaccccgagggtcgccagcagtactttgcccagacttgtccggtaatcgcaatgacggcgcacgacgcaattgagtggagagccaagctcagccggtgggatatctcttttgacagcgcagtggtggtcgaggcaggccagctgtcggagttgaccaccgtgctaaccatacccaacatggtgagtcgggtggtactcattggtgatgagacccatgtagtgcccaccaccacggttcgagacgaggtagacctcgtgctggaccacgggtacggggtgagtcagagtctgttgagcaggctggtacgactcggagtgcccaaggtggatcttagcgaggttgtcgaccccgaaaagtcgttgaccctgtcgatccctcgaatccctcgaggccacagtagtggtgatgcagtgtcggcaaactcggggctggggtatactttccaggtgattgatgtgaccgagggagtggaagaacgaatggacggagtggtccagaacgctgcagaggccgagtacgcagtgtggttataccagtacatgcgactgctggggtaccctgcgtgcacgattgccattgtcactgccactcacggacaacggcaactggtgcaagacattgtcgataccagagcacgaggtacaattgtggaccgggaaattttcggggccccaggactaatagccactgtgcacgaataccagggcgtgagccacgactatgtcatttgtagcacggtttttactcggaccccgtttgattaccggacccagcaccgacaacaggcagtgcggggagccctggcaggcgctcgcaaagggttgtacgtgctgagtcgaaaagaggtgattcaggcgaccgaattgaaggactttgtggtcgaatctccggacaacaagctggcggtggtgccccgggagctgtacggcaagtcaaggcgtcagtggaacgattgcaccggcgcagtgaccatggaaaatgtagaccatttgggcatgtatgtacgccaaatgacgggccaacggatcgagcacgataaaaagcggcagcgcctggcaaatgctatataactccgtccatactcaataacgggtcaattaactttactagtaaactctgcaagctggccacagctgccaactacatccaactacacctacagcacccaacccgtggtctctacctacagctacctacagcactcacctacatcacttcaccttacagatcttcaggtcacgacatttgcatcgccaaattcccgtttccgcccacaaccgaacgagcagcccgaagagcagccggcacaaccgactttgagcacgtgactcaaccacctgattatccaactgtccatacggttatcttcggctaatcaccgagcacctttgtcgccccggcaaaagtcccttatcgtccaatacaaatgtaccgggcaataaccgcccgggccgcgtccaatattcgcagggccgccagccgcacctccactaccaccctgtctcgatcgctgagcggcgcatccatgcaaggcggcgcggctggcgacaatgggggtcctgatcataaatataataacctccagcttgcccctaatcgatatcagactcagttagtagaggaagcgagtgccatgtccgagggcaaccgatcgaagggagtgcacgacattcgtgccagctccaatttgctgggctctatgaacaagattctaggtaagtaatcgctcatttctttgttatcagtgtgctaactcagtcgcaaaccgaggagaaattcgtaagtacaactattggagtagtcttggtgtgggcaagccaactggcaccagctggcagcgactggcacgctacaatggtacacgacaatggacaaatggcataaaaccaccaccagcaatcgctagcactcgctagctgtcgctaaccgatattcccggtaaaacaccgaacaagcttgccagcggggttctgtgactaatttgcctcagaacaaaaaaaaaataattttttttctggaatgcttggtggctgcctggatgtctggcggattgctggtcagacgtatctaaactcttggaagtttacattacgatacatttggataggaccctattgcagtgcatggccgatcggtgatgcagcctttggtttcctctaggggtaattcctctagaggaaggtgccagtaatgtgctgtcgaggggaccaatattgtgcatttggaatgagtcagagcccccaggggtgtccaagggtcctgttgtcgtgttggttgtgcctgtggttaattgtgtcttgattaccgctgttttcgtgcctgtggccgcctgtcgccgcctgtcgccgctctctccacaccgttatgacggtgcgtttctatgttttttctacatgagtactaactgcagccattcgagtaagtcatgcaggcactggaaaaattagtccgaccgagccgttgagctctctgtgattggacaggtcgatgcattatcacttgttcgattcactgagtgatgaaactttttggagcctcctgcggcggagcttagattgatccttggatcggatccatggaatgaatgaatggtgctaacaatagattttccgaactgcccatgagctgtctatgcagaccgtggccatctacgcccatgaagacattctgtccatgcatcgattgagtaagtaatttgctgtgttttgtgatttgctgtacaaaaagcggtgctaacaaatagaggccgatgaagcctatgtgatcggtgaggttggccagtactctcctgtgcaggcttacctgcagagtgatgagatcatcaagatcgcaaaggctcacggagtcaacatgatccacccgggttatggattcctgtctgagaactcggagtttgccaaaaaggttgaggaggccggaatcgcctgggtgggccctcctcctcaggtaattgactctgtaggagacaaggtgtctgctcgtcagctcgccatcaagtgcgatgtgcccgtggtgcccggtactcccggcccaattgatgacgtccaagaggcaaagcagtttgttgaaaagtatggctaccccgtcatcatcaaggccgcctttggtggtggtggacgtggtatgcgagtggtccgtgagggtgaggacattgtcgacgccttcaaccgtgccgtgtccgaggccaagactgcatttggcaacggtaccgtgttcattgagcggttcctcaacaagcccaagcacattgaggtccagctgcttgccgacggcgagggtaacgtaatccacctgtttgagcgtgactgttccgtccagcgtcgtcaccagaaggtggtggagattgcccccgcaattgatctccctgtcgaggtccgcgacaacattctcaaggacgccgtcaagctggcaaagaccgcaaactaccgcaacgccggtaccgccgagttcctggtcgacgaccagaaccgtcactactttattgagatcaaccctcgtatccaggtcgagcacactattactgaggagattactggaattgacattgtcgctgctcagatccagattgccgccggcgctaccctggagcagcttggtctgacccaggaccgcatctccatccgtggatgcgccattcagtgccgaatcaccaccgaggacccctccaagggcttccagcctgacactggtaagattgaggtgtaccgatccactggtggaaacggagttcgtctggacggaggaaacggtttcgctggtgcggtcatttctccttactacgactccatgttggtcaagtgctcttgtctgggctccaactacgagattgcccgtcgtaagatgctgcgatctctggtcgagttccgtatccgtggtgtcaagactaacattcctttcctgctcaagcttctcactcacgaaacgttcattgccggcaagtgctggaccacctttattgatgacactcctagtctgtttgacatgcttcactctcagaaccgtgcccagaagctgctgtcgtacctggccgacatttttgtcaacggttctcagatcaagggtcagattggtctgcccaagctcaagggccaccccactgtgcctcagctcaaggacaattccggcaaggttgtcgacgtaaccactcctcccaccgagggatggagaaaggtgctggtcgaggagggccccgatgcgtttgcaaagaagattcgcgctcacaagggtgctttgatcatggacaccacctggcgagacgcccaccagtctctgctggctacccgtgtccgtactcacgacctgctgcgaattgctcccaccaccgctcacgccctgtcgggcgcttttgccctcgagtgttggggaggtgccaccttcgatgtggccatgcgattccttcacgaagacccttgggaccgtctgcgcaagctgcgaaaggccgtgcctaacattcctttccagatgcttctgcgtggtgctaacggagtggcctactcgtcgcttcccgacaatgccattgagcacttctgcaagcaggccaaggacaatggtgtggacattttccgagtgtttgatgctcttaacgacttggagcagctccgagtcggtgtcgacgctgtcaagaaggctggcggagtggtcgaggctaccatctgctactctggagacatgctcaaccccagcaagaagtacaacctccagtactacctcaacatggccgacgaggtggtcaagatgggcactcacattcttggaatcaaggatatggccggtactatgaagcctgctgctgccaccaagctcattggcgctctgcgagagcgataccctgacttgcctatccacgtgcacactcacgactctgccggaactggtgtggcctccatgaccgccgctgccctggctggagctgacgctgtagacgctgcctccaactccatgtccggaatgacctctcaaccttccatctctgctctggttgcctctcttcagggctctcttgacactggcctcaacccctcgtacctgcgagaaattgacagctactgggctcagatgcgtctgctgtactcgcctttcgaggcggatctcaagggacctgaccctgaggtgtacgagcacgagatccccggtggtcagctcaccaaccttatcttccaggctcagcaggttggtctgggtgctcagtgggccgagactaagaagacctatgagcaggccaacgagctgttgggtgacattgtcaaggtcactcctacctcgaaggttgtgggagaccttgctcagttcatggtgtccaacaagctcactcctaaggacgttgaggagcgtgctaacgagctcgacttccctggttcggttcttgacttcttccagggactcatgggattcccatacggaggcttccctgaacccctgcgatccaaggtcctggagggtaagcgcgagaagttcactgagcgacccggaaagactctgcccccattgaactttgacgagcttcgcgccgacctggagaagcgcttcggcagcatcaccgagtgcgacattgcctcttacaacatgtaccccaaggtgtttgaggactaccgcaagacccttgagaagtacggagatctgtctgttcttcctacccagtacttccttgctcctcctgagatcggcaaggagttctctgtggagattgaccagggtaagattctggttctcaagtgcgttgccgtcggtgacctttctctgcagactggtacccgagaggtgtactttgaggtcaacggagagatgcgaaacgtcactgttgaggaccgcactgctgccgtggagactgtcactcgtgctaaggccgatgctcacaaccctaatgagattggtgctcccatggctggaatggtcgtggaggtccgtgtccaggaaggctctgaggtcaagaagggtgaccccgttgctgtgctgtctgccatgaagatggagatggttatcagtgctcctgtatccggaaaggttggtgaattgcttgtcagagccggagagtctgttgatggaaacgacttgctctgtcgcattgtcaagcccactgcccatgacgcttcccaggtcgacattcctgttggcgtgcctatgaacgagggagtcgctcccctcaagtaa

SEQ ID NO: 85 - protein, 2494 aa, Arxula adeninivorans; identical to SEQ ID NO: 83

SEQ ID NO: 86 - DNA, 7485 bp, Arxula adeninivorans
atggtaccttcgctagaggagattcacgaatcggaattgtaccaaattgcgcaggctagctggttagacagagaagagtctgtggacgatgttacacgcgtggttgctgaaatttggtcggcgttgaccaagaccaacttcggagaatcttcagttttgattctcgaacagtcaaaagcatttgaaagcattctattcccttcgtttagtgaagattcatctgatgagcacacaatcctgacagttttggtggccaattcgaaactggccaggggcttaccactgtgggatttggttgagagagacccagatgtctttgagagtttatttaacagagtggtggcattggcattgcccgggaacgctgatgacggtatcattaatgaccatcgggcacatctcattctatttgttacagcatgtttctatcacctggaattggcggtgattcgcaaactaattgggccattaatatcaatttcaatttggacgcatctagaggctaaagtcagggaaggcattctgtctgaacacccatcacttgccaaagcctggaaacgatcgcagaagaaactccaatcagctaaccaagaaaagaaacaggaaatggtcctgcagtcggattggatatactcattgctaagttcattgcataaggttaatgacccgctctgtaaaagagcgtacgtccaccttttgatagctattgcatcacaactgcccaccaggcggtaccccaatactctttttaagcagttgcaggtgctcccgattctaagactcagctataaggatcaggctgatgtggtggatattttggagaattacatgtactttagcatagacgactactccggggagcctttgacagaagtggaagtatgggagcgacactcaaaagaggttcggacactgcaacaggttgcattttcgcagttccgagaaaaacttcatctattggcattgactaattttgactctatccatcaccgtccagaactggaggagcacctggcaccgctagatttggatgagctcaagagccttgcggatgctgttggtatttctaccgacagactgggtatggaagccacccgggagcttgtagttgagtgctttgtgcaaaagtacaagcaacggaactggaaaccctggctggatatggatctgcttcccacagaaaaaagtctttttgaccccatttacgaatattggacgagattatgcagagatgacaagccatgtttgccaatgggtggatacaatgttggatcacagtatctcaccacggacgacatgctgtttcgcagcatgaaggtaaacaccgtggcgcaattcactcggatacgccaggatatccagtatgtgatggaccatctgcagccagcggtatccgggggtcggaaacgaggcattgatggtcagcatgtggactctgttgaaaaggtagagtttggtggatacagtaaaagggccaccttaatagcggagggacccagtattgtcgaaaagagcacgccgttgtttggacaattgtatccaggcaaggtattagttgaaactatcattgacctaggagtaatgccgcggggcgatgtacaggaatgggatagatcagtgaccccggggtcgcttttgtgtcttgccaaactggcagcgcctcagaacagagctctggatggacagcaatatggaattgagcatatccgcactgctcgagtcagtaaggtacttgatggcaagggccagcctataagacaggaagaagacgatgatgacactgagaatgggtttaaacgaagagcaaaaaagagtggtgagatccgcaaactagtacttgaaattgacccccgtgggtttttggacccgaaagaagactctgtggttgagagcctcaactttgtggccagactcccccatttacaagacaatgcggtcaaaagtggtggtgtagatgaacttccatcgtggctggccgacgtagtcctgggatttggggaccccaccagcgctagtgtagaggcccgtggaaccgaagaggttgatttcgtggatacaattcttgatcaaagtcatcttgaggagtgcctcggagagcaagtttctaatgttgaaagaggcatcgctgcgccatacaaattctcctataaacttgagggccctatagaggttcacgaaggacaaaaggtggatttgaaaaacaagatccggttcaataccaaccaggtgcatgcaatttgccgtggagccaaccgtgggctaacattggtgcagggcagtaatggaacaggcaagacgtcagttggagcccaggtcattaacgttctttatcattctacgaaaaggaacaaaacgctgctgattagtcgcaccagtcgtgctctggaaaggcatcttgaccgactgctggaactaggggtggacattaagcatatgatccacctgtgctcagagccatcatcatcatcatcatcatcaaaatacaacggatcaagctactgggagcttcgtggccctttacttggcaaggtggaccttttggccaaagcaatggcggtgcccggagctcatggcgacagctgtgagacggcagagtacttttaccaaacgcatgtcaagccagtcaaggacgctggaaagcaagctcctctacaggactacagctgggaagatgtagacaagctatttagagatttgcgagagattcggccgctggaattggtcaaaaaccccgagggtcgccagcagtactttgcccagacttgtccggtaatcgcaatgacggcgcacgacgcaattgagtggagagccaagctcagccggtgggatatctcttttgacagcgcagtggtggtcgaggcaggccagctgtcggagttgaccaccgtgctaaccatacccaacatggtgagtcgggtggtactcattggtgatgagacccatgtagtgcccaccaccacggttcgagacgaggtagacctcgtgctggaccacgggtacggggtgagtcagagtctgttgagcaggctggtacgactcggagtgcccaaggtggatcttagcgaggttgtcgaccccgaaaagtcgttgaccctgtcgatccctcgaatccctcgaggccacagtagtggtgatgcagtgtcggcaaactcggggctggggtatactttccaggtgattgatgtgaccgagggagtggaagaacgaatggacggagtggtccagaacgctgcagaggccgagtacgcagtgtggttataccagtacatgcgactgctggggtaccctgcgtgcacgattgccattgtcactgccactcacggacaacggcaactggtgcaagacattgtcgataccagagcacgaggtacaattgtggaccgggaaattttcggggccccaggactaatagccactgtgcacgaataccagggcgtgagccacgactatgtcatttgtagcacggtttttactcggaccccgtttgattaccggacccagcaccgacaacaggcagtgcggggagccctggcaggcgctcgcaaagggttgtacgtgctgagtcgaaaagaggtgattcaggcgaccgaattgaaggactttgtggtcgaatctccggacaacaagctggcggtggtgccccgggagctgtacggcaagtcaaggcgtcagtggaacgattgcaccggcgcagtgaccatggaaaatgtagaccatttgggcatggccgccagccgcacctccactaccaccctgtctcgatcgctgagcggcgcatccatgcaaggcggcgcggctggcgacaatgggggtcctgatcataaatataataacctccagcttgcccctaatcgatatcagactcagttagtagaggaagcgagtgccatgtccgagggcaaccgatcgaagggagtgcacgacattcgtgccagctccaatttgctgggctctatgaacaagattctagtcgcaaaccgaggagaaattcccattcgaattttccgaactgcccatgagctgtctatgcagaccgtggccatctacgcccatgaagacattctgtccatgcatcgattgaaggccgatgaagcctatgtgatcggtgaggttggccagtactctcctgtgcaggcttacctgcagagtgatgagatcatcaagatcgcaaaggctcacggagtcaacatgatccacccgggttatggattcctgtctgagaactcggagtttgccaaaaaggttgaggaggccggaatcgcctgggtgggccctcctcctcaggtaattgactctgtaggagacaaggtgtctgctcgtcagctcgccatcaagtgcgatgtgcccgtggtgcccggtactcccggcccaattgatgacgtccaagaggcaaagcagtttgttgaaaagtatggctaccccgtcatcatcaaggccgcctttggtggtggtggacgtggtatgcgagtggtccgtgagggtgaggacattgtcgacgccttcaaccgtgccgtgtccgaggccaagactgcatttggcaacggtaccgtgttcattgagcggttcctcaacaagcccaagcacattgaggtccagctgcttgccgacggcgagggtaacgtaatccacctgtttgagcgtgactgttccgtccagcgtcgtcaccagaaggtggtggagattgcccccgcaattgatctccctgtcgaggtccgcgacaacattctcaaggacgccgtcaagctggcaaagaccgcaaactaccgcaacgccggtaccgccgagttcctggtcgacgaccagaaccgtcactactttattgagatcaaccctcgtatccaggtcgagcacactattactgaggagattactggaattgacattgtcgctgctcagatccagattgccgccggcgctaccctggagcagcttggtctgacccaggaccgcatctccatccgtggatgcgccattcagtgccgaatcaccaccgaggacccctccaagggcttccagcctgacactggtaagattgaggtgtaccgatccactggtggaaacggagttcgtctggacggaggaaacggtttcgctggtgcggtcatttctccttactacgactccatgttggtcaagtgctcttgtctgggctccaactacgagattgcccgtcgtaagatgctgcgatctctggtcgagttccgtatccgtggtgtcaagactaacattcctttcctgctcaagcttctcactcacgaaacgttcattgccggcaagtgctggaccacctttattgatgacactcctagtctgtttgacatgcttcactctcagaaccgtgcccagaagctgctgtcgtacctggccgacatttttgtcaacggttctcagatcaagggtcagattggtctgcccaagctcaagggccaccccactgtgcctcagctcaaggacaattccggcaaggttgtcgacgtaaccactcctcccaccgagggatggagaaaggtgctggtcgaggagggccccgatgcgtttgcaaagaagattcgcgctcacaagggtgctttgatcatggacaccacctggcgagacgcccaccagtctctgctggctacccgtgtccgtactcacgacctgctgcgaattgctcccaccaccgctcacgccctgtcgggcgcttttgccctcgagtgttggggaggtgccaccttcgatgtggccatgcgattccttcacgaagacccttgggaccgtctgcgcaagctgcgaaaggccgtgcctaacattcctttccagatgcttctgcgtggtgctaacggagtggcctactcgtcgcttcccgacaatgccattgagcacttctgcaagcaggccaaggacaatggtgtggacattttccgagtgtttgatgctcttaacgacttggagcagctccgagtcggtgtcgacgctgtcaagaaggctggcggagtggtcgaggctaccatctgctactctggagacatgctcaaccccagcaagaagtacaacctccagtactacctcaacatggccgacgaggtggtcaagatgggcactcacattcttggaatcaaggatatggccggtactatgaagcctgctgctgccaccaagctcattggcgctctgcgagagcgataccctgacttgcctatccacgtgcacactcacgactctgccggaactggtgtggcctccatgaccgccgctgccctggctggagctgacgctgtagacgctgcctccaactccatgtccggaatgacctctcaaccttccatctctgctctggttgcctctcttcagggctctcttgacactggcctcaacccctcgtacctgcgagaaattgacagctactgggctcagatgcgtctgctgtactcgcctttcgaggcggatctcaagggacctgaccctgaggtgtacgagcacgagatccccggtggtcagctcaccaaccttatcttccaggctcagcaggttggtctgggtgctcagtgggccgagactaagaagacctatgagcaggccaacgagctgttgggtgacattgtcaaggtcactcctacctcgaaggttgtgggagaccttgctcagttcatggtgtccaacaagctcactcctaaggacgttgaggagcgtgctaacgagctcgacttccctggttcggttcttgacttcttccagggactcatgggattcccatacggaggcttccctgaacccctgcgatccaaggtcctggagggtaagcgcgagaagttcactgagcgacccggaaagactctgcccccattgaactttgacgagcttcgcgccgacctggagaagcgcttcggcagcatcaccgagtgcgacattgcctcttacaacatgtaccccaaggtgtttgaggactaccgcaagacccttgagaagtacggagatctgtctgttcttcctacccagtacttccttgctcctcctgagatcggcaaggagttctctgtggagattgaccagggtaagattctggttctcaagtgcgttgccgtcggtgacctttctctgcagactggtacccgagaggtgtactttgaggtcaacggagagatgcgaaacgtcactgttgaggaccgcactgctgccgtggagactgtcactcgtgctaaggccgatgctcacaaccctaatgagattggtgctcccatggctggaatggtcgtggaggtccgtgtccaggaaggctctgaggtcaagaagggtgaccccgttgctgtgctgtctgccatgaagatggagatggttatcagtgctcctgtatccggaaaggttggtgaattgcttgtcagagccggagagtctgttgatggaaacgacttgctctgtcgcattgtcaagcccactgcccatgacgcttcccaggtcgacattcctgttggcgtgcctatgaacgagggagtcgctcccctcaagtaa

SEQ ID NO: 87 - protein, 575 aa, Arxula adeninivorans
MAPPSKKQKTGSSEIALGNYLFTRLKQLNVDTIFGVPGDFNLALLDHVYDVEGLRWAGNTNELNAGYAADGYSRVKQLAAIVTTFGVGELSALAAIAGSYAEHVGVVHIVGIPSTSAQNKHLLLHHTLGNGDFTVFHSMSRKISQETWIINDPTRATADIDNAIRTAYVHQRPVYVGVPANFADFKVPANLLETPIDLSVEPNPAEAEEEVIENVLELISKAERPIILVDACAARHHVQAETNELAKKTQFPVFVTPMGKSMFDEHHPRFGGVYVGSLSDPEVSEVVENADLVLSVGAMLSDFNTGSFSYHYATKNIVEFHSDHTKIRSASYPDVRMKALLQKVTARLSQKDVKKDVVPVPSVKTSVTPRPPSTRISQQWLWTRLSSWLRPGDIIISETGTSSFGIIQTKFPKNTIGISQILWGSIGYSVGSTFGAAMAAQEIDENRRVILFVGDGSLQLTVTEISSMIRWGLKPYLFVLNNDGYTIERLIHGEKQSYNDVQMWKYANLLDLFNAKDHQSVTVGETGELDDLFNSKEFSTPSKIRLIEVMLPRMDAPTNLVKQAQITAATNSQNE

SEQ ID NO: 88 - DNA, 1728 bp, Arxula adeninivorans
atggcacccccatccaagaagcaaaagaccggttcgtcggaaattgccctcggcaattacctgtttacccgtcttaagcaactcaatgttgacaccatcttcggagtgccaggagactttaaccttgctctgctggatcacgtttacgacgttgagggcctgagatgggccggaaacaccaatgagctcaacgccggatacgctgccgacggatactcgcgggtcaagcaattggctgccattgtcaccacttttggagtgggagagctgtctgctctggccgccattgctggttcgtacgctgagcacgtcggtgtggttcacattgtgggtatcccttctacttctgcacagaacaagcacctgctgctgcaccacaccctgggaaatggcgactttactgttttccactccatgagtcgaaagatctcccaggagacttggattatcaacgaccctaccagggctactgctgacattgacaatgctatccgcactgcttatgtgcaccagcgccctgtgtacgttggagttcctgccaactttgccgatttcaaggttcccgccaacctgttggagactccaattgacctgtcggtggagcctaaccccgccgaagccgaggaggaagtgattgagaacgttctggagctgatcagcaaggccgagcgacccatcattcttgttgacgcttgcgctgcgcgacaccatgtccaggctgagaccaatgaattggccaagaagacccagttcccagtgtttgtcaccccaatgggtaagtccatgtttgacgagcaccaccctcgtttcggaggagtgtacgtgggctctctgtccgaccctgaggtgtctgaggttgtagagaatgccgacttggtcctgtctgtcggtgctatgctctcggactttaacactggatccttctcttaccactatgccaccaagaacattgtcgagttccactctgaccacaccaagatccgatccgcgtcctaccccgacgtgcgaatgaaggctctgctgcaaaaggtgactgctcgcctgtcccagaaggatgtcaagaaggacgttgtccccgttccttcggtcaagacctcggtcactcctcgtcctccttccactcgcatctcccagcagtggctgtggactcgtctgagctcgtggctgcgtcctggtgacattatcatttccgagactggtacgtcatcgttcggtatcatccagacaaagttccccaagaacaccattggaatttcccagattctgtggggatccattggttactcagtgggatctacttttggtgctgctatggctgctcaggagattgacgagaaccgccgagttatcctgtttgttggtgatggttctttgcagctcaccgttaccgaaatctccagcatgattcgatggggactcaagccatacctgtttgtcctcaacaatgacggatacaccattgagcgtctgatccatggtgagaagcagtcgtacaacgatgttcagatgtggaagtacgccaaccttctggatctgttcaacgcaaaggaccaccagtccgtcaccgtaggagagaccggagagcttgacgatctgttcaattccaaggaattcagcactccatcaaagattcgactcattgaggtcatgcttcctcgtatggatgctcctactaacctcgtcaagcaggcccagatcactgctgccaccaactctcaaaacgaataa

SEQ ID NO: 89 - protein, 337 aa, Arxula adeninivorans
MLAAAKTAVSRRAFSTTAAAASKVAVLGAAGGIGQPLSLLLKLNKNVTDLALYDLRGTPGVAADVGHVDTNSVVNGYTPDNNGLSEALKGAEVVVIPAGVPRKPGMTRDDLFNTNASIVRDLTKAIGENCPNAFVAIISNPVNSTVPIVAEVLKKQGVYDPKRVFGVTTLDLLRASRFISQVQGTDPTQEPVNVVGGHSGATIVPLISQSNHPDISGETLDKLVHRIQFGGDEVVKAKDGAGSATLSMAQAGARFAGVLLEARSGKQVVENSFVESPLFKSEGIDFFSSKVTIGPNGVEKIHELGQVSQYEEGLLEACKKDLVKNIKKGQDFVAQNP

SEQ ID NO: 90 - DNA, 1014 bp, Arxula adeninivorans
atgctcgccgccgctaagaccgctgtttctcgtcgtgccttctccaccaccgctgccgctgcctccaaggttgctgtgctcggtgctgctggtggaattggtcagcctctgtccctgctcctcaagctcaacaagaatgtgaccgacctggctctttacgatcttcgaggaacccccggtgtcgctgctgatgttggacacgtcgacaccaactctgttgtcaacggatacactcccgacaacaatggactgtctgaggcccttaagggagccgaggttgtggtcatccccgctggtgtgccccgaaagcctggtatgacccgagacgacctgttcaacaccaacgcctccattgtgcgagacctgaccaaggccattggtgagaactgccccaacgcctttgtggccattatctccaaccccgtcaactctactgtccccattgttgccgaggtgctcaagaagcagggtgtctacgaccccaagcgagtgttcggtgtgaccactctggatctgctgcgagcttctcgattcatctctcaggttcagggcactgaccctacccaggagcccgtcaacgtggttggaggacactctggtgctaccattgttcccctcatctcccagtctaaccaccctgacatttctggcgagaccctcgacaagctggttcaccgaatccagttcggaggtgacgaggttgtcaaggctaaggacggtgctggatctgctactctgtccatggctcaggctggtgcccgattcgccggtgttctgcttgaggcccgttctggcaagcaggttgttgagaactcgtttgtggagtctcctctgttcaagtctgagggaattgacttcttttcttccaaggtcaccattggacccaacggagttgagaagatccacgagcttggccaggtttctcagtacgaggagggtcttctcgaggcctgcaagaaggaccttgtcaagaacatcaagaagggacaggactttgttgcccagaacccttaa

SEQ ID NO: 91 - protein, 331 aa, Arxula adeninivorans
MVKAVVAGASGGIGQPLSLLLKLSPYVTELSLYDVVNSPGVAADLSHISSTGPVKGFLPKDDGLKNALTGAKIVVIPAGIPRKPGMTRDDLFKINAGIVRDLIEGVAQYCPDAFVLIISNPVNSTVPIAAEVLKKHNAFNPKKLFGVTTLDVVRAQTFVAEIVGESDPTKYKVPVIGGHSGETIVPLLSLTEPKASIPSDKVAGLINRIQFGGDEVVKAKDGAGSATLSMAYAGYRFAEAVLRGAAGEKNVVEPSFVYLDGVDGGSAVKETVGVDFFSVPVEFGPSGAEKVHNILSSVSDEEKGLIKTAVSGLQGNISKGIDFIANPPPAK

SEQ ID NO: 92 - DNA, 1048 bp, Arxula adeninivorans
atggttaaagctgtagttgccggtgcctctggaggaattggtcagcccctttccttgctgctcaagctctctccttacgtgactgagctgtctctgtacgatgtcgtcaactctcccggagtggcggccgacctttcgcacatttcgtccactggacctgtcaagggattcctgcccaaggacgatggcctcaagaacgctctcactggagccaagattgtggttatccctgctggaattccccgaaagcccggaatgactcgagacgacctgttcaagattaacgctggtatcgtccgagacctaattgagggtgtcgcccagtactgccccgacgcttttgtgctgatcatttccaaccccgtcaactctaccgtgcccattgctgccgaggtgctcaagaagcacaatgctttcaaccccaagaagctgtttggtgtcaccaccctggacgttgtgcgtgcccagaccttcgtggctgagattgtaggcgagtctgaccctaccaagtacaaggttcctgtcattggcggtcactctggagagaccattgtccctctgctgtctctgaccgagcccaaggcctcaattccttccgacaaggttgctggcctgatcaaccgaatccagtttggtggtgacgaggttgtcaaggccaaggacggtgctggctctgctactctgtctatggcctacgctggataccgattcgctgaggccgttcttcgaggagctgccggcgagaagaacgttgtcgagccctcctttgtctacttggacggagttgacggaggttctgccgtcaaggagaccgttggagtggacttcttctccgtccccgtggagtttggtgtaagtatatttctacccccgctaacaattgtctacctgcttactaacatagccctctggagccgaaaaggtccacaacatcctgtcctctgtttccgacgaggagaagggtcttatcaagactgctgtttctggccttcagggcaacatttccaagggaatcgacttcattgccaaccctccccctgccaagtaa

SEQ ID NO: 93 - protein, 331 aa, Arxula adeninivorans; identical to SEQ ID NO: 91

SEQ ID NO: 94 - DNA, 996 bp, Arxula adeninivorans
atggttaaagctgtagttgccggtgcctctggaggaattggtcagcccctttccttgctgctcaagctctctccttacgtgactgagctgtctctgtacgatgtcgtcaactctcccggagtggcggccgacctttcgcacatttcgtccactggacctgtcaagggattcctgcccaaggacgatggcctcaagaacgctctcactggagccaagattgtggttatccctgctggaattccccgaaagcccggaatgactcgagacgacctgttcaagattaacgctggtatcgtccgagacctaattgagggtgtcgcccagtactgccccgacgcttttgtgctgatcatttccaaccccgtcaactctaccgtgcccattgctgccgaggtgctcaagaagcacaatgctttcaaccccaagaagctgtttggtgtcaccaccctggacgttgtgcgtgcccagaccttcgtggctgagattgtaggcgagtctgaccctaccaagtacaaggttcctgtcattggcggtcactctggagagaccattgtccctctgctgtctctgaccgagcccaaggcctcaattccttccgacaaggttgctggcctgatcaaccgaatccagtttggtggtgacgaggttgtcaaggccaaggacggtgctggctctgctactctgtctatggcctacgctggataccgattcgctgaggccgttcttcgaggagctgccggcgagaagaacgttgtcgagccctcctttgtctacttggacggagttgacggaggttctgccgtcaaggagaccgttggagtggacttcttctccgtccccgtggagtttggtccctctggagccgaaaaggtccacaacatcctgtcctctgtttccgacgaggagaagggtcttatcaagactgctgtttctggccttcagggcaacatttccaagggaatcgacttcattgccaaccctccccctgccaagtaa

SEQ ID NO: 95 - protein, 387 aa, Arxula adeninivorans
MLRTVRPLSANGVKAGVRAMHTGKDLVKINLSEDSFATYNFDAPSLEVEISKDELLQMYKDMVVVRRLEMAADALYKAKKIRGFCHLSTGQEAVAVGIEHAITRADSIITAYRCHGFAYMRGASVKGVIGELLGKRSGVSYGKGGSMHMFAPNFYGGNGIVGAQVPVGAGVAFAHKYLNEKAAMFNLYGDGASNQGQIFESYNMAKLWNLPCIFACENNKYGMGTAASRSSALTDYYKRGQYIPGLKVNGMDVLAVYQASKLAKEYSTAGNGPLVMEFETYRYGGHSMSDPGTTYRSREEIQQMRSTKDPITGLQHRLMELDIATEKELKAVDKEARAKVEEEVAAAEADAPPEAKAQILFEDVYVPGTEIPVLRGRIPSENWSFQK

SEQ ID NO: 96 - DNA, 1164 bp, Arxula adeninivorans
atgttgcgaacggtgcgacctttgagcgccaatggcgtcaaggccggtgtgcgagctatgcacactggtaaggatctggttaagattaacctttctgaagactcgtttgctacctacaactttgatgctccttctttggaggtagaaatctccaaggatgagctgctccagatgtacaaggacatggttgtggttcgtcgtctggaaatggctgccgacgccctgtacaaggccaagaagattcgaggattctgccatctgtccactggtcaggaggccgtggcggttggaattgagcacgctatcacccgtgctgactccatcatcactgcctaccgatgccacggtttcgcttacatgcgaggagcttcggtcaagggagtcattggtgagcttctgggaaagcgatccggtgtttcttacggaaagggaggttccatgcacatgtttgctcctaacttctacggaggaaacggtatcgtaggagcccaggtgcccgtgggagccggagtggcctttgcccacaagtacctcaacgagaaggctgccatgttcaacctgtacggagatggtgcctctaaccagggtcagatctttgagtcgtacaacatggccaagctgtggaacctgccttgtatcttcgcttgcgagaacaacaagtacggtatgggtactgccgcttcgcgatcctcggccttgaccgactactacaagcgtggacagtacatccctggtcttaaggtcaatggaatggacgttcttgctgtttaccaggcctccaagctcgccaaggagtactccactgctggcaatggtcctctggtgatggagttcgagacttaccgatacggtggtcactccatgtccgaccctggtaccacctaccgatcccgagaggagattcagcagatgcgttccaccaaggaccccatcaccggtctccagcaccgtctcatggagcttgacattgctaccgagaaggagctcaaggctgtcgacaaggaggcccgtgccaaggtcgaggaggaggttgctgccgccgaggctgatgctcctcctgaggccaaggcccagattctgtttgaggacgtctacgtccccggcactgagattcctgttctgcgaggacgcattccctccgagaactggtcgtttcaaaagtaa

SEQ ID NO: 97 - protein, 389 aa, Arxula adeninivorans
MKTLSSTKRLASTLSKGVIVPKAKEVLVPRTSLKAPGLNAALRTGIQTRQASSNGGATTMTVRDALNAAMAEEMDRDETVFLMGEEVAQYNGAYKVSKGLLDRFGEKRVIDTPITEMGFAGLCVGSALAGLKPICEFMTWNFAMQAIDQIINSGAKTFYMSGGTQQCNVTFRGPNGAAAGVAAQHSQDYAAWYGSIPGLKVVSPYSSEDAKGLLKSSIRDPNVTVFLENEIMYGDSFPMSEEAMSPDFTIPFGQAKIERPGTDVTIVAHSRNVGTSLQAADILKKESNVEAEVINLRTIKPLDVPSIIKSVKKTNRLVSVEAGFPAFGVGSEIAAQAMETEMFDYLDAPVMRVTGAEVPTPYAIELENFAFPTPEIVAKACRQVLYLEE

SEQ ID NO: 98 - DNA, 1728 bp, Arxula adeninivorans
atgaagactctgtcctcgaccaagcggttggcttctaccctttccaagggtgtcattgtgcccaaggctaaggaggtgcttgttccccgcacctctctcaaggctcctggtctcaatgctgccctgcgaaccggtattcagacccgtcaggcttcttccaacggaggtgctactactgtaagtatattgacttgaaggcgacggtagggatggcataggggtagtcagaagaatatgggtgaatgagaatggtgtgctacgagattgattcctcgataaaccgtcgagatgtgttcacattggactgggaaacattgttgcagttgaaatcgacatgaaacgtttaatgatttgcaactagtacggtctacacgttggtatgaggtcttttgtcaattcttgttttttgtttgatggatatcgtgactatggactttctagtacagtctttcttacaattgaaaagttattccggccgatgacccctatcacctcaatctcacaacgatgaaatgaacacaacaccgagtgctatgtcctagagctagtaccggtaccaaaccctttttcattttcactcccctgtttcttactctggctattcttttgcatgtacaccccctccattaaccgagtcgatacggacatggccgggtgtcgactcggttctggctctgattgccgcacaggattgatccgatgcactacagttttgatgaaaatgtactaacgtagatgactgtgcgtgatgccctcaatgccgccatggccgaggagatggaccgagatgagactgtcttcctcatgggtgaggaggtcgctcagtacaatggtgcctacaaggtgtccaagggtctgctggaccgattcggtgagaagcgagtcattgacactcctattaccgagatgggtttcgctggtctctgtgtgggatctgccctggctggacttaagcccatttgtgagtttatgacctggaactttgccatgcaggccattgaccagatcatcaactctggtgctaagaccttctacatgtccggaggtacccagcagtgcaatgtcaccttccgaggacctaacggagctgctgccggtgtagctgctcagcattcccaggactacgctgcctggtacggatccatccccggtcttaaggttgtgtctccttactcttctgaagacgccaagggtctgctgaagagctccatccgtgaccccaacgtgaccgtgttcctcgagaacgaaattatgtacggtgactccttccccatgtccgaggaggccatgtcccccgactttactattcctttcggccaggccaagattgagcgtcctggtactgacgttaccattgtggcccactcccgaaacgttggcacttctcttcaggccgctgacattctcaagaaggagagcaacgttgaggctgaggtcatcaacctccgaaccatcaagcctctggatgttccttccatcatcaagtcggttaagaagaccaaccgtctggtgtctgtggaggctggattccctgccttcggtgttggttctgagattgctgctcaggccatggagactgagatgttcgactaccttgacgctcccgtcatgcgtgtcactggtgctgaggtccctactccttacgccattgagctcgagaactttgccttccctacccctgagattgtcgcaaaggcatgccgacaggtcctttaccttgaggagtaa

SEQ ID NO: 99 - protein, 389 aa, Arxula adeninivorans; identical to SEQ ID NO: 97

SEQ ID NO: 100 - DNA, 1170 bp, Arxula adeninivorans
atgaagactctgtcctcgaccaagcggttggcttctaccctttccaagggtgtcattgtgcccaaggctaaggaggtgcttgttccccgcacctctctcaaggctcctggtctcaatgctgccctgcgaaccggtattcagacccgtcaggcttcttccaacggaggtgctactactatgactgtgcgtgatgccctcaatgccgccatggccgaggagatggaccgagatgagactgtcttcctcatgggtgaggaggtcgctcagtacaatggtgcctacaaggtgtccaagggtctgctggaccgattcggtgagaagcgagtcattgacactcctattaccgagatgggtttcgctggtctctgtgtgggatctgccctggctggacttaagcccatttgtgagtttatgacctggaactttgccatgcaggccattgaccagatcatcaactctggtgctaagaccttctacatgtccggaggtacccagcagtgcaatgtcaccttccgaggacctaacggagctgctgccggtgtagctgctcagcattcccaggactacgctgcctggtacggatccatccccggtcttaaggttgtgtctccttactcttctgaagacgccaagggtctgctgaagagctccatccgtgaccccaacgtgaccgtgttcctcgagaacgaaattatgtacggtgactccttccccatgtccgaggaggccatgtcccccgactttactattcctttcggccaggccaagattgagcgtcctggtactgacgttaccattgtggcccactcccgaaacgttggcacttctcttcaggccgctgacattctcaagaaggagagcaacgttgaggctgaggtcatcaacctccgaaccatcaagcctctggatgttccttccatcatcaagtcggttaagaagaccaaccgtctggtgtctgtggaggctggattccctgccttcggtgttggttctgagattgctgctcaggccatggagactgagatgttcgactaccttgacgctcccgtcatgcgtgtcactggtgctgaggtccctactccttacgccattgagctcgagaactttgccttccctacccctgagattgtcgcaaaggcatgccgacaggtcctttaccttgaggagtaa

SEQ ID NO: 101 - protein, 499 aa, Arxula adeninivorans
MSDGRYEFKNNATIVVAGASGDLAKKKTFPALFALFKGGRLPAKTRIVGYARTKMDEAEFHKRLTSHLKAPTDEDAKKVEEFKEISSYVSGQYDTDDGFIELRKHIEELEKGPVSEGLKRDRLFYLALPPSVFGQVAAHLKHNVYPGKEGTARIIIEKPFGSDLSSYRALQAEISPEWSEEDVYRIDHYLGKEMVKNMLYFRFTNQFLHGVWNKENIAAVKISFKEPFGTEGRGGYFDEIGIIRDVMQNHLLQVLTLVAMERPVTFSPEDIRDEKVKVLKSMRQLNPHEVVLGQYGKSADGSKPAYVDDDTVPEGSRAVTFAAFECKIDNDRWQGVPFILSAGKALDEGRVDIRIQFKEVVPFRGHEAPQRNELRIRVQPKEAITMSVNSKLPGLHNGVSVTDLDLSYAARFKDAYIPEAYEALILDALREDHSNFVRDDELDESWSIFTPLLHYIEDKNNKINLENYPYGSTGPSSYSKFLEDRGFIELTPGPYQSNL

SEQ ID NO: 102 - DNA, 1902 bp, Arxula adeninivorans
atgtcagacggacgttacgagtttaagaacaatgctaccattgtagtagcgggagcttcgggagaccttgctaagaagaagactgtaagtatatacccacacacaacgagggcctggtgggaaaaaaagaggcatttacaaatgatggactttgacaagcggaaaggtcggaaagcgtggacgactcgatcgttgagatgtacgaactgtaattcgggcgagtattgtattgcaagtgtattactcaattttccgggtctcttgttgatctagggttgggttgcttgttcgggggggattgaccgccacagtactcttgtcagattggtttggacaaatgaacaaacaatcgagcgggattcgattcagagaacctggaagaacctgccctttgtttgtttgatactcgatgctttctttgttgctttgttttgctttcctctgctatcctcgttcatttcctttacatacttttactaacaatagttccctgctctgtttgctctgttcaagggtggacgtctgcccgcaaagaccagaattgttggatatgctagaaccaagatggacgaagccgaattccacaagcgactgacctctcacctgaaagcgcccactgacgaggatgccaagaaggttgaagaattcaaggagatttcctcctatgtgtctggtcagtacgacaccgacgatggattcattgagctccgaaagcacattgaggagctcgagaagggccccgtgtccgagggactgaagcgggaccgtctcttctacttggccctgcctccctctgtgtttggccaggttgctgcccacctcaagcacaatgtgtaccctggaaaggagggtaccgcccgaattatcattgaaaagccttttggatctgacctttcttcataccgcgccctccaggctgagatcagccctgagtggtccgaggaggatgtgtaccgaattgaccactacctcggtaaggagatggtcaagaacatgctgtacttccgattcaccaaccagttcttgcacggagtgtggaacaaggagaacattgctgccgtcaagatttcgttcaaggagccattcggtactgagggccgaggaggatactttgacgagattggtattattcgagatgtaatgcagaaccatttgctccaggtgttgaccttggtggctatggagcgccccgtcaccttctctcctgaggacattcgtgatgagaaggtcaaggttcttaagagcatgcgtcagttgaacccccacgaggttgtactgggtcagtacggcaagtctgccgacggatccaagcctgcctacgtggatgatgacactgttcctgagggatctcgagcagttacttttgctgcatttgagtgcaagattgataatgaccgatggcagggagtgcctttcatcctgtcggccggaaaggccctggatgagggacgagtggacattcgcatccagttcaaggaggttgtgcctttccgaggccatgaagcccctcagcgcaacgagctgcgaatccgtgtgcagcctaaggaggccatcaccatgtccgttaactccaagcttcccggactccacaatggagtgagcgtcactgacctggacctgtcctacgctgctcgattcaaggatgcttacattcccgaggcttacgaggctcttattctggatgctctgcgagaggaccactccaactttgttagagatgatgagttggacgagtcctggagcatcttcacccctcttctgcactacattgaggacaagaacaacaaaatcaacttggagaactacccctatggatctactggaccaagttcctactcaaagtttttggaagaccggggttttattgagttgacccctggtccttaccagtccaatctctaa

SEQ ID NO: 103 - protein, 499 aa, Arxula adeninivorans; identical to SEQ ID NO: 101

SEQ ID NO: 104 - DNA, 1500 bp, Arxula adeninivorans
atgtcagacggacgttacgagtttaagaacaatgctaccattgtagtagcgggagcttcgggagaccttgctaagaagaagactttccctgctctgtttgctctgttcaagggtggacgtctgcccgcaaagaccagaattgttggatatgctagaaccaagatggacgaagccgaattccacaagcgactgacctctcacctgaaagcgcccactgacgaggatgccaagaaggttgaagaattcaaggagatttcctcctatgtgtctggtcagtacgacaccgacgatggattcattgagctccgaaagcacattgaggagctcgagaagggccccgtgtccgagggactgaagcgggaccgtctcttctacttggccctgcctccctctgtgtttggccaggttgctgcccacctcaagcacaatgtgtaccctggaaaggagggtaccgcccgaattatcattgaaaagccttttggatctgacctttcttcataccgcgccctccaggctgagatcagccctgagtggtccgaggaggatgtgtaccgaattgaccactacctcggtaaggagatggtcaagaacatgctgtacttccgattcaccaaccagttcttgcacggagtgtggaacaaggagaacattgctgccgtcaagatttcgttcaaggagccattcggtactgagggccgaggaggatactttgacgagattggtattattcgagatgtaatgcagaaccatttgctccaggtgttgaccttggtggctatggagcgccccgtcaccttctctcctgaggacattcgtgatgagaaggtcaaggttcttaagagcatgcgtcagttgaacccccacgaggttgtactgggtcagtacggcaagtctgccgacggatccaagcctgcctacgtggatgatgacactgttcctgagggatctcgagcagttacttttgctgcatttgagtgcaagattgataatgaccgatggcagggagtgcctttcatcctgtcggccggaaaggccctggatgagggacgagtggacattcgcatccagttcaaggaggttgtgcctttccgaggccatgaagcccctcagcgcaacgagctgcgaatccgtgtgcagcctaaggaggccatcaccatgtccgttaactccaagcttcccggactccacaatggagtgagcgtcactgacctggacctgtcctacgctgctcgattcaaggatgcttacattcccgaggcttacgaggctcttattctggatgctctgcgagaggaccactccaactttgttagagatgatgagttggacgagtcctggagcatcttcacccctcttctgcactacattgaggacaagaacaacaaaatcaacttggagaactacccctatggatctactggaccaagttcctactcaaagtttttggaagaccggggttttattgagttgacccctggtccttaccagtccaatctctaa

SEQ ID NO: 105 - protein, 474 aa, Arxula adeninivorans
MGQNLILNAADHGYTVVAYNRTVSKVDHFLDNEAKGKSIIGAHSIEELVANLKRPRRIILLVKAGAAVDQFIDQLLPHLEKGDIIIDGGNSYFPDSNRRYESLKEKGFLFVGSGVSGGEEGARNGPSLMPGGHEDAWPHIKNIFQDVAAKTDGQPCCDWVGPAGAGHFVKMVHNGIEYGDMQLITEAYDLLKRAGFSIKEIGDAFEQWNKGVLDSYLIEITRDILRFNDKDGQPLVEKILDTAGQKGTGKWTAINALDLGMPVTLIGEAVFSRCLSAIKDERVRASEVLKGPTPQFTGDKKQFVDELEQALYASKIISYAQGFMLIREAGKEYGWQLNNAGIAHMWRGGCIIRSVFLGEISKAYKEDPKLENLLLVPFFRDAIQKAQSSWRKVVSTAALWGVPTPAFSTALSFYDGYRSARLPANLLQAQRDYFGAHTFRVLPEFATNELPKDQDIHINWTGKGGNVSASTYAV

SEQ ID NO: 106 - DNA, 1425 bp, Arxula adeninivorans
atgggtcagaacctgatcctgaacgctgctgaccacggatacaccgttgttgcttacaaccgaactgtgtccaaggtcgaccacttcttggacaacgaggccaagggcaagagcatcattggtgcccactccattgaggagcttgttgctaatctgaagcgaccccgtcgtatcattctgctggtcaaggccggtgccgctgttgaccagttcattgaccagctgctgccccacctcgagaagggtgacatcatcattgacggaggaaactcttacttccccgactctaaccgtcgttacgagtccctcaaggagaagggattcctctttgtcggatctggtgtgtccggaggagaggagggtgcccgaaacggaccttccctcatgcccggtggacacgaggacgcctggcctcacattaagaacatcttccaggatgttgccgccaagactgacggtcagccctgttgcgactgggttggacctgctggtgccggacacttcgtcaagatggtccacaacggtattgagtacggtgacatgcagctcatcactgaggcttacgatctcctgaagcgtgccggattctccatcaaggagattggtgacgctttcgagcagtggaacaagggtgttcttgactcttacctgattgagattacccgtgacattctgcgattcaacgacaaggacggccagcctctggtcgagaagatccttgacactgccggacagaagggaaccggaaagtggactgccattaacgctctggacctgggaatgcccgtcaccctgattggtgaggccgtcttctctcgatgcctttctgccatcaaggacgagcgtgtccgtgcatccgaggttctcaagggacctactcctcagttcaccggagacaagaagcagttcgtcgacgagctcgagcaggctctgtacgcttccaagatcatctcctacgcccagggattcatgcttatccgtgaggccggtaaggagtacggatggcagctcaacaacgctggaattgcccacatgtggcgaggaggatgtatcatccgatctgtcttccttggagagatctccaaggcttacaaggaggaccccaagctggagaacctgcttctcgtccccttcttccgcgatgctatccagaaggcccagagctcgtggcgaaaggttgtgtccaccgctgctctgtggggagttcccactcctgctttcagcactgccctgtccttctacgacggttaccgatctgctcgtctccctgctaaccttctgcaggctcagcgtgactactttggtgctcacactttccgtgtgctgcccgagttcgctaccaacgagctgcctaaggaccaggacatccacatcaactggactggaaagggtggtaacgtctctgcctctacttatgctgtttaa

SEQ ID NO: 107 - protein, 463 aa, Arxula adeninivorans
MSLSRSIRPSIKNARLMGVASRLYSTKEPTLKERFAELLPEKQEQVKKLRKEHGNTVLGEVTLDQVYGGMRGIKALVWEGSVLDAEEGIRFRGRTIPDLQKELPKAPGGAEPLPEALFWLLLTGEVPTESQVRTLSAEFAARAGLPKHVEELVDRCPPSLHPMAQLSLAINALESESTFAKAYERGVNKKEYWQYTYEDAIDLIAKIPTIAARIYRNVFKDGKVAAIDNSLDYSANFANMLGFGDNKEFIELMRLYLTIHTDHEGGNVSAHTTHLVGSALSSPFLAVAAGMNGLAGPLHGRANQEVLEWILEMKSKIGTNVSNADIEKYLWDTLNAGRVVPGYGHAVLRKTDPRYTAQREFALKHMPDYDLFNLVSKVYEVAPGVLTQHGKTKNPWPNVDSHSGVLLQYYGLNEQAFYTVLFGVSRTIGVLPQIIIDRALGMPIERPKSFSTEKYAELVGAKL

SEQ ID NO: 108 - DNA, 1699 bp, Arxula adeninivorans
atgtcgctttctcgctctatccgtccttcgatcaagaatgcccgcctcatgggtgtggcctcccgattgtactccactaaggagcctgtaagtattttgtgtcgtggttgattgggggttcctattggaaaaacaaagcccttcgtggccacgggccgatgaatgtgaatatatgggcaagctggtatgctggggttcaaaaaagaaggcacagcgcttctagaactgctagaactggcacttactattgtcaagcacggtttgcattcttgtgctctggtgatgatgttggccttgtggacagcaatattttttccgatgggaccttctggttggccgagatgtgtggagacccacatgtgtagatgagagctgcaggttgctaacaatgtagactctgaaggagcgattcgccgagctgttgcctgagaagcaggagcaggttaagaagctgcgaaaggagcacggtaacactgttctgggagaggtcactctcgaccaggtttacggtggtatgcgtggaatcaaggcccttgtgtgggaaggatctgtgctggacgctgaggagggaatccgattccgtggccgcaccatccctgaccttcagaaggagctccccaaggctcctggcggagctgagcccctccctgaggccctgttctggcttctgctgaccggagaggtccccactgagtcccaggtgcgaaccctctctgccgagtttgctgcccgtgctggtcttcccaagcacgttgaggagctcgttgaccgatgccctccttcccttcaccccatggctcagctgtctctggccatcaacgctctggagtctgagtccaccttcgccaaggcttacgagcgaggtgtcaacaagaaggagtactggcagtacacttacgaggatgctattgacctcattgccaagattcccaccattgctgcccgtatctaccgaaacgttttcaaggacggtaaggtcgctgctatcgacaactctcttgattactctgccaactttgccaacatgcttggatttggcgacaacaaggagttcattgagctcatgcgtctgtacctgaccatccacactgaccacgagggaggaaacgtgtctgctcacaccacccacttggttggatccgccctttcctctcctttcctggccgtggctgctggtatgaacggtctggccggtcctctgcacggacgtgctaaccaggaggtgcttgagtggatcttggagatgaagtccaagattggcaccaacgtgtccaacgctgacattgagaagtacctgtgggacactcttaacgctggccgtgtcgtgcccggttacggacacgccgtcctgcgaaagactgaccctcgttacactgctcagcgagagtttgctctcaagcacatgcctgactacgacctgttcaaccttgtgtccaaggtttacgaggttgctcctggtgtgctcacccagcacggaaagaccaagaacccctggcccaacgtggactcccactccggagttcttctccagtactacggactcaacgagcaggccttctacactgtcctgttcggtgtttcccgaaccattggtgtgcttcctcagatcatcattgaccgtgctctgggaatgcctatcgagcgccccaagtccttctctactgagaagtacgccgagctggtcggagctaagctttaa

SEQ ID NO: 109 - protein, 463 aa, Arxula adeninivorans; identical to SEQ ID NO: 107

SEQ ID NO: 110 - DNA, 1392 bp, Arxula adeninivorans
atgtcgctttctcgctctatccgtccttcgatcaagaatgcccgcctcatgggtgtggcctcccgattgtactccactaaggagcctactctgaaggagcgattcgccgagctgttgcctgagaagcaggagcaggttaagaagctgcgaaaggagcacggtaacactgttctgggagaggtcactctcgaccaggtttacggtggtatgcgtggaatcaaggcccttgtgtgggaaggatctgtgctggacgctgaggagggaatccgattccgtggccgcaccatccctgaccttcagaaggagctccccaaggctcctggcggagctgagcccctccctgaggccctgttctggcttctgctgaccggagaggtccccactgagtcccaggtgcgaaccctctctgccgagtttgctgcccgtgctggtcttcccaagcacgttgaggagctcgttgaccgatgccctccttcccttcaccccatggctcagctgtctctggccatcaacgctctggagtctgagtccaccttcgccaaggcttacgagcgaggtgtcaacaagaaggagtactggcagtacacttacgaggatgctattgacctcattgccaagattcccaccattgctgcccgtatctaccgaaacgttttcaaggacggtaaggtcgctgctatcgacaactctcttgattactctgccaactttgccaacatgcttggatttggcgacaacaaggagttcattgagctcatgcgtctgtacctgaccatccacactgaccacgagggaggaaacgtgtctgctcacaccacccacttggttggatccgccctttcctctcctttcctggccgtggctgctggtatgaacggtctggccggtcctctgcacggacgtgctaaccaggaggtgcttgagtggatcttggagatgaagtccaagattggcaccaacgtgtccaacgctgacattgagaagtacctgtgggacactcttaacgctggccgtgtcgtgcccggttacggacacgccgtcctgcgaaagactgaccctcgttacactgctcagcgagagtttgctctcaagcacatgcctgactacgacctgttcaaccttgtgtccaaggtttacgaggttgctcctggtgtgctcacccagcacggaaagaccaagaacccctggcccaacgtggactcccactccggagttcttctccagtactacggactcaacgagcaggccttctacactgtcctgttcggtgtttcccgaaccattggtgtgcttcctcagatcatcattgaccgtgctctgggaatgcctatcgagcgccccaagtccttctctactgagaagtacgccgagctggtcggagctaagctttaa

SEQ ID NO: 111 - protein, 457 aa, Arxula adeninivorans
MFRSFNKSVARQLGVRYSSSGPSLKQTLKDVIPAKKELLKKVKTDLGQKSLGDCKVENLLGGMRGLKAMLWEASVLDPNEGIRFHGKSIKECQEFLPKAPEGGEMLPEAMLWFLITGKVPSEGQIRELSRELAEKGNLPDHVVKTLDNLPPTLHPMSQFAIAVTQLNHDSKFAKAYERGIPKSDYWEYTFDDSIDLIAKLPQIAAKIYQNTYRNGAPLAGEIDLSFDWSKNYARMIGKDDNAGFVDLLRLYFALHGDHEGGNVSAHATHLVGSALSDPYLSYSAGLQGLAGPLHGLAAQEVLRFVLDMKKDIPENYTSKDVTDHLWSVLNSGRVIPGYGHAVLRQPDPRFQALMAFAESRPEVSADPVYQLVRSISEVAPGVLTEHGKTKNPFPNVDSSSGVLFHHYGITETLYYTVTFGVCRSLGPLPQLIWDRILGLPIERPKSLSLEKIVELTK

SEQ ID NO: 112 - DNA, 1710 bp, Arxula adeninivorans
atgtttcgatcctttaacgtaagtgaaaattgaaaaaagaacgagcgggcgatggctcctggactggcttttcaacgaagccagtaatcccatacgaccgactagctcaggtagggattgtaccaaacaatggaacgtgacagcgtctcagcacaatggtcaacattggccgtcagggcttaatttcaacgaagcgcccattggtaatcccattgtaccttgttgagtttaaagttggctgttggggatcgcgtctcgttcatgatcgaacgtaccagggtcgaagggtcccgagtaagcttggtgctctaccgtcatgcagaattggaaagcaacgcaagtatactaacatagaaatccgtagctcgacagcttggtgtgcgctattcgtcatcaggtcctagtcttaaacagactctgaaggatgttattcctgcaaagaaggaattgcttaaaaaggtaaagactgacctgggccaaaagtctctgggagactgtaaggtggagaacctcctcggaggtatgcgaggcctcaaggctatgttgtgggaagcctcggtcttggaccccaacgagggtattcgattccatggcaagtctattaaggaatgtcaggaattccttcccaaggctcccgagggaggagaaatgctccccgaggccatgctgtggttcctcatcaccggaaaggtgccctcggagggtcagatccgagaactatcccgagagcttgctgagaagggtaacctccctgaccatgttgtcaagaccttggacaaccttccaccaactctgcacccaatgtcccagtttgcaattgcagtgacccagcttaaccacgactcaaaattcgcaaaggcctacgagcgaggaattccaaagtcggactactgggagtacacttttgacgattccattgacctcattgctaagctcccccagattgctgcaaagatttaccaaaatacctaccgtaatggcgctcctttggccggtgaaattgacctttccttcgattggtcaaagaactatgcccgaatgattggcaaggacgataatgctggattcgtcgacctcctgcgattgtactttgcccttcacggagatcacgagggaggtaacgtgtctgctcatgctactcatttggtgggttcggccctctctgacccttacctgtcttactctgctggtcttcagggtcttgccggtcccctccacggtctggctgcccaggaggttctgcgatttgtcctggatatgaagaaggacattccagagaactacacttccaaggatgttactgatcacttgtggtcggttctgaactctggacgagttatccccggttacggacatgccgttctccgccagcccgatcctcgattccaggctcttatggcttttgccgagtctcgccccgaagtttctgcagaccccgtgtaccaattggttcgctccatttctgaggtggctcctggagtgcttacggagcacggaaagaccaagaaccccttccccaacgtggactcgtcttcgggagttctgttccaccattatggaatcaccgagaccctctattacacagtcacatttggagtctgccgatctctaggtcctcttcctcagctcatttgggaccgaatcctgggtctgcctattgagcgacccaagtccctgtctctggagaagatcgttgagcttacaaagtag

SEQ ID NO: 113 - protein, 457 aa, Arxula adeninivorans; identical to SEQ ID NO: 111

SEQ ID NO: 114 - DNA, 1374 bp, Arxula adeninivorans
atgtttcgatcctttaacaaatccgtagctcgacagcttggtgtgcgctattcgtcatcaggtcctagtcttaaacagactctgaaggatgttattcctgcaaagaaggaattgcttaaaaaggtaaagactgacctgggccaaaagtctctgggagactgtaaggtggagaacctcctcggaggtatgcgaggcctcaaggctatgttgtgggaagcctcggtcttggaccccaacgagggtattcgattccatggcaagtctattaaggaatgtcaggaattccttcccaaggctcccgagggaggagaaatgctccccgaggccatgctgtggttcctcatcaccggaaaggtgccctcggagggtcagatccgagaactatcccgagagcttgctgagaagggtaacctccctgaccatgttgtcaagaccttggacaaccttccaccaactctgcacccaatgtcccagtttgcaattgcagtgacccagcttaaccacgactcaaaattcgcaaaggcctacgagcgaggaattccaaagtcggactactgggagtacacttttgacgattccattgacctcattgctaagctcccccagattgctgcaaagatttaccaaaatacctaccgtaatggcgctcctttggccggtgaaattgacctttccttcgattggtcaaagaactatgcccgaatgattggcaaggacgataatgctggattcgtcgacctcctgcgattgtactttgcccttcacggagatcacgagggaggtaacgtgtctgctcatgctactcatttggtgggttcggccctctctgacccttacctgtcttactctgctggtcttcagggtcttgccggtcccctccacggtctggctgcccaggaggttctgcgatttgtcctggatatgaagaaggacattccagagaactacacttccaaggatgttactgatcacttgtggtcggttctgaactctggacgagttatccccggttacggacatgccgttctccgccagcccgatcctcgattccaggctcttatggcttttgccgagtctcgccccgaagtttctgcagaccccgtgtaccaattggttcgctccatttctgaggtggctcctggagtgcttacggagcacggaaagaccaagaaccccttccccaacgtggactcgtcttcgggagttctgttccaccattatggaatcaccgagaccctctattacacagtcacatttggagtctgccgatctctaggtcctcttcctcagctcatttgggaccgaatcctgggtctgcctattgagcgacccaagtccctgtctctggagaagatcgttgagcttacaaagtag

SEQ ID NO: 115 - protein, 493 aa, Arxula adeninivorans
MSSVFADITLPQGTKITQPTGLFINNEFVPSASGKTFAVENPSTEEKVVDVFEAEEQDVDKAVDAAEKAFETWQFEDPKIRGQLMLKLADLLEKHAEILAEIESMDNGKALKFAKGDIALVIDVIRNYAGWADKIYGDVVETDKDHFTYTRREPIGVCGQIIPWNFPLLMWSWKFGPAIACGNTIVMKTAESTPLSALYTCQLIKEAGFPPGVFNLVSGAGPTGQFISAHMKIKKVAFTGSTATGRHIMRSAAMSNLKKVTLELGGKSPNIVFEDADLEKAVELVNAGIFFNSGEVCCAGSRIYVQESIYDKFVELFKKRAEATKVGHPFDRDTFYGPQTSKLQLDRVLSYIQHGKDEGAKVLTGGNRVDRKGYYVEPTIFSDVTEDMKIVKEEIFGPVVTITKFKDVDHALKMAHDTSYGLAAGVHTNDVNKAVGVANRIKAGTIWVNTYNDFHHQVPFGGYGQSGIGRELGKEALDSYTQTKAVRLALGKI

SEQ ID NO: 116 - DNA, 1482 bp, Arxula adeninivorans
atgtcgtctgtattcgctgatatcacccttcctcagggaactaaaatcacccagcccacgggtctgttcatcaacaatgagtttgtgccctcggccagtggaaagacctttgcggtcgagaacccttccaccgaagaaaaggtggtagatgtgttcgaagccgaggagcaggatgtagacaaggccgtcgacgctgccgagaaggcgtttgagacgtggcagtttgaggaccctaagatccgaggccagctcatgctcaagctcgcagacctgctggagaagcacgccgaaattctggctgaaattgagtcgatggataacggaaaggccctcaagtttgccaagggagacattgctctggtaattgatgtcatccgtaactacgccggatgggccgacaagatttacggagacgttgtggagaccgacaaggaccactttacctacactcgacgagagcccattggtgtgtgcggacagattatcccttggaacttccctctgctcatgtggtcgtggaagtttggaccagcaattgcatgcgggaacaccattgtcatgaagactgccgagtccactcctctgtccgccctttacacctgtcaactcatcaaggaggctggtttccctcctggtgtctttaacctggtgtcgggagctggccctactggtcagtttatctctgcccacatgaagattaagaaggttgctttcaccggctccaccgccactggtcgtcacattatgcgctcggccgccatgtccaacctcaagaaggtcactctggagctgggaggaaagtctcccaacattgtgttcgaggacgctgacctcgaaaaggccgtggagcttgtcaatgccggaatcttcttcaactccggagaggtgtgctgtgccggttctcgtatttacgtccaggagtccatctacgacaagtttgtggagctgttcaagaagcgtgccgaggccaccaaggttggacacccctttgaccgcgacaccttctacggaccccagacttccaagctccagcttgaccgagtcttgtcgtacattcagcacggaaaggatgagggcgccaaggtgcttactggaggtaaccgagtcgaccgcaagggatactacgtggagcctaccattttctctgacgtgactgaggacatgaagattgtcaaggaggagattttcggacccgtggtgaccattacaaagttcaaggatgttgaccacgctctcaagatggcccacgacaccagctacggtcttgctgctggtgtgcacaccaacgatgtcaacaaggccgttggagtcgccaaccgtatcaaggctggaaccatctgggtcaacacctacaacgatttccaccaccaggtgcccttcggaggttacggacagtctggaattggccgagaactcggaaaggaggctctggactcgtacactcagaccaaggctgttcgtcttgctcttggaaagatctaa

SEQ ID NO: 117 - protein, 514 aa, Yarrowia lipolytica
MTIDSQYYKSRDKNDTAPKIAGIRYAPLSTPLLNRCETFSLVWHIFSIPTFLTIFMLCCAIPLLWPFVIAYVVYAVKDDSPSNGGVVKRYSPISRNFFIWKLFGRYFPITLHKTVDLEPTHTYYPLDVQEYHLIAERYWPQNKYLRAIITTIEYFLPAFMKRSLSINEQEQPAERDPLLSPVSPSSPGSQPDKWINHDSRYSRGESSGSNGHASGSELNGNGNNGTTNRRPLSSASAGSTASDSTLLNGSLNSYANQIIGENDPQLSPTKLKPTGRKYIFGYHPHGIIGMGAFGGIATEGAGWSKLFPGIPVSLMTLTNNFRVPLYREYLMSLGVASVSKKSCKALLKRNQSICIVVGGAQESLLARPGVMDLVLLKRKGFVRLGMEVGNVALVPIMAFGENDLYDQVSNDKSSKLYRFQQFVKNFLGFTLPLMHARGVFNYDVGLVPYRRPVNIVVGSPIDLPYLPHPTDEEVSEYHDRYIAELQRIYNEHKDEYFIDWTEEGKGAPEFRMIE

SEQ ID NO: 118 - DNA, 1545 bp, Yarrowia lipolytica
atgactatcgactcacaatactacaagtcgcgagacaaaaacgacacggcacccaaaatcgcgggaatccgatatgccccgctatcgacaccattactcaaccgatgtgagaccttctctctggtctggcacattttcagcattcccactttcctcacaattttcatgctatgctgcgcaattccactgctctggccatttgtgattgcgtatgtagtgtacgctgttaaagacgactccccgtccaacggaggagtggtcaagcgatactcgcctatttcaagaaacttcttcatctggaagctctttggccgctacttccccataactctgcacaagacggtggatctggagcccacgcacacatactaccctctggacgtccaggagtatcacctgattgctgagagatactggccgcagaacaagtacctccgagcaatcatcaccaccatcgagtactttctgcccgccttcatgaaacggtctctttctatcaacgagcaggagcagcctgccgagcgagatcctctcctgtctcccgtttctcccagctctccgggttctcaacctgacaagtggattaaccacgacagcagatatagccgtggagaatcatctggctccaacggccacgcctcgggctccgaacttaacggcaacggcaacaatggcaccactaaccgacgacctttgtcgtccgcctctgctggctccactgcatctgattccacgcttcttaacgggtccctcaactcctacgccaaccagatcattggcgaaaacgacccacagctgtcgcccacaaaactcaagcccactggcagaaaatacatcttcggctaccacccccacggcattatcggcatgggagcctttggtggaattgccaccgagggagctggatggtccaagctctttccgggcatccctgtttctcttatgactctcaccaacaacttccgagtgcctctctacagagagtacctcatgagtctgggagtcgcttctgtctccaagaagtcctgcaaggccctcctcaagcgaaaccagtctatctgcattgtcgttggtggagcacaggaaagtcttctggccagacccggtgtcatggacctggtgctactcaagcgaaagggttttgttcgacttggtatggaggtcggaaatgtcgcccttgttcccatcatggcctttggtgagaacgacctctatgaccaggttagcaacgacaagtcgtccaagctgtaccgattccagcagtttgtcaagaacttccttggattcacccttcctttgatgcatgcccgaggcgtcttcaactacgatgtcggtcttgtcccctacaggcgacccgtcaacattgtggttggttcccccattgacttgccttatctcccacaccccaccgacgaagaagtgtccgaataccacgaccgatacatcgccgagctgcagcgaatctacaacgagcacaaggatgaatatttcatcgattggaccgaggagggcaaaggagccccagagttccgaatgattgagtaa

SEQ ID NO: 119 - protein, 348 aa, Rhodosporidium toruloides
MGQQATPEELYTRSEISKIKFAPFGVPRSRRLQTFSVFAWTTALPILLGVFFLLCSFPPLWPAVIAYLTWVFFIDQAPIHGGRAQSWLRKSRIWVWFAGYYPVSLIKSADLPPDRKYVFGYHPHGVIGMGAIANFATDATGFSTLFPGLNPHLLTLQSNFKLPLYRELLLALGICSVSMKSCQNILRQGPGSALTIVVGGAAESLSAHPGTADLTLKRRKGFIKLAIRQGADLVPVFSFGENDIFGQLRNERGTRLYKLQKRFQGVFGFTLPLFYGRGLFNYNVGLMPYRHPIVSVVGRPISVEQKDHPTTADLEEVQARYIAELKRIWEEYKDAYAKSRTRELNIIA

SEQ ID NO: 120 - DNA, 1858 bp, Rhodosporidium toruloides
atgggccagcaggcgacgcccgaggagctatacacacgctcagagatctccaagatcaagcaagtcgagccagctcttctcctcaccaccccacaacataccccgcagcccacgacagccctcccacagcacctgcagcctgctgaccagctcgagaacacccacagattcgcaccctttggcgtcccgcggtcgcgccggctgcagaccttctccgtctttgcctggacgacggcactgcccatcctactcggcgtcttcttcctcctctggtgcgtcaggcttggcgtgatctgagagtagcgggcggatcatctgacctgcttcttcgctgcagctcgttcccaccgctctggccggctgtcattgcctacctcacctgggtctttttcattgaccaggcgccgattcacggtggacgggcgcagtcttggctgcggaagagtcggatatgggtctggtttgcaggatactatcccgtcaggtgcgtcctctttccaagcctgcgtctcgaggcctcgctcacggccaactcgcccgaccggctacctccgaactttccgtcaacagcttgatcaaggtcagtctgcgcgtctctcgacttcagtgctctgtggaggagctgcgccattgggcccgacctgcggagggcctcaaaggacgatgccgctgacttcctttcctccgacagagcgccgacttgccgcctgaccggaagtacgtctttggctaccacccgcacggcgtcataggcatgggcgccatcgccaacttcgcgaccgacgcaaccggcttctcgacactcttccccggcttgaaccctcacctcctcaccctccaaagcaacttcaagctcccgctctaccgcgagttgctgctcgctctcggcatatgctccgtctcgatgaagagctgtcagaacattctgcgacaaggtgagcggtatgcgcaagacgggcggtcaagcgtgaacgcagtgaacgagaagagctgaccttccgccttactccatccgtgcaggtcctggctcggctctcactatcgtcgtcggtggcgccgccgagagcttgagtgcgcatcccggaaccgccgatcttacgctcaagcgacgaaaaggcttcatcaaactcgcgatccggcaaggcgccgaccttgtgcccgtcttttcgttcggcgagaacgacgtgcgcacgctctccgagtctctaaaccggaagcgaatgctgaccgctgcccaattctctctccagatctttggccagctgcgaaacgagcgaggaacgcggctgtacaagttgcagaagcgtttccaaggcgtgtttggcttcaccctccgtacgtctcaccgcgccgtcttgccgaactgctcgttcagtcgctcacgcagctttcactcgcgcagctctcttctacggccggggactcttcaactgtgcgctcgagttcaccgcttcgccaacagcgaggaatgcctccgagtacagcccagctgacgccccatctcttctcatagacaacgtcggattgatgccgtatcgccatccgatcgtctctgtcggtgtgaacccgctctgtcgctcctacctgcgttccttaggctgacaccactcgcgtcaaacagtcggtcgaccaatctcggtagagcagaaggaccacccgaccacggcggacctcgaagaagttcaggcgcggtatatcgcagaactcaagcggtacgttccaagtcgtctgcctccgcttgccgcctcaaataagctgaggcgtgctgaccgtatctgccgaaccgtacagcatctgggaagaatacaaggacgcctacgccaaaagtcgcacgcgggagctcaatattatcgcctga

SEQ ID NO: 121 - protein, 348 aa, Rhodosporidium toruloides; identical to SEQ ID NO: 119

SEQ ID NO: 122 - DNA, 1047 bp, Rhodosporidium toruloides
atgggccagcaggcgacgcccgaggagctatacacacgctcagagatctccaagatcaagttcgcaccctttggcgtcccgcggtcgcgccggctgcagaccttctccgtctttgcctggacgacggcactgcccatcctactcggcgtcttcttcctcctctgctcgttcccaccgctctggccggctgtcattgcctacctcacctgggtctttttcattgaccaggcgccgattcacggtggacgggcgcagtcttggctgcggaagagtcggatatgggtctggtttgcaggatactatcccgtcagcttgatcaagagcgccgacttgccgcctgaccggaagtacgtctttggctaccacccgcacggcgtcataggcatgggcgccatcgccaacttcgcgaccgacgcaaccggcttctcgacactcttccccggcttgaaccctcacctcctcaccctccaaagcaacttcaagctcccgctctaccgcgagttgctgctcgctctcggcatatgctccgtctcgatgaagagctgtcagaacattctgcgacaaggtcctggctcggctctcactatcgtcgtcggtggcgccgccgagagcttgagtgcgcatcccggaaccgccgatcttacgctcaagcgacgaaaaggcttcatcaaactcgcgatccggcaaggcgccgaccttgtgcccgtcttttcgttcggcgagaacgacatctttggccagctgcgaaacgagcgaggaacgcggctgtacaagttgcagaagcgtttccaaggcgtgtttggcttcaccctccctctcttctacggccggggactcttcaactacaacgtcggattgatgccgtatcgccatccgatcgtctctgtcgtcggtcgaccaatctcggtagagcagaaggaccacccgaccacggcggacctcgaagaagttcaggcgcggtatatcgcagaactcaagcggatctgggaagaatacaaggacgcctacgccaaaagtcgcacgcgggagctcaatattatcgcctga

SEQ ID NO: 123 - protein, 348 aa, Rhodosporidium toruloides; identical to SEQ ID NO: 119

SEQ ID NO: 124 - DNA, 1047 bp, Rhodosporidium toruloides
atgggacagcaggctacccccgaggagctctacacccgatccgagatttctaagattaagttcgccccttttggagtgccccgatcccgacgactccagaccttctccgtttttgcctggaccactgctctgcccattctgctcggcgtcttctttctgctctgctctttcccccctctctggcccgccgtcatcgcttacctgacctgggtgttctttatcgaccaggcccctattcacggcggtcgagctcagtcctggctgcgaaagtctcgaatttgggtttggttcgccggttactaccccgtctctctcatcaagtcggctgacctgccccctgatcgaaagtacgtgttcggctaccaccctcatggtgttatcggtatgggagccattgctaactttgccaccgatgctactggtttctccaccctctttcccggactgaaccctcacctgctcactctccagtctaacttcaagctccccctgtaccgagagctgctcctggccctgggtatctgctccgtctctatgaagtcttgtcagaacattctccgacagggacctggttcggctctgaccatcgtcgtgggaggagctgctgagtcgctctccgcccatcctggaaccgctgacctcactctgaagcgacgaaagggcttcatcaagctcgccattcgacagggtgctgacctggtgcccgttttctcctttggagagaacgatattttcggccagctgcgaaacgagcgaggaacccgactctacaagctgcagaagcgatttcagggtgtgttcggcttcaccctccctctgttctacggacgaggcctctttaactacaacgttggactgatgccctaccgacaccctatcgtctcggttgtcggccgacccatttccgtggagcagaaggaccatcctaccactgccgatctcgaggaggtgcaggcccgatacatcgctgagctgaagcgaatttgggaggagtacaaggacgcctacgctaagtctcgaacccgagagctgaacatcattgcctaa

SEQ ID NO: 125 - protein, 410 aa, Lipomyces starkeyi
MSEKAEIEVPPQKSTFPRSVHFAPLHIPLERRLQTLAVLFHTVALPYCIGLFFLMLAFPPFWPLLVMYVIYAYGFDHSSSNGEISRRRSPLFRRLPLFRLYCDYFPIHIHREVPLEPTFPGRLREPSGLVERWIAKMFGVQDAVVEGNESDVKATANGNGTTKEIGPTYVFGYHPHGIVSLGAFGAIGTEGAGWEKLFPGIPVSLLTLETNFSLPFYREYLLSLGIASVSRRSCTNLLKHDQSICIVIGGAQESLLAEPGTLDLILVKRRGFVKLAMSTARVSDQPICLVPILSFGENDVYDQVRGDRSSKLYKIQTFIKKAAGFTLPLMYARGIFNYDFGLMPYRRQMTLVVGKPIAVPYVAQPTEAEIEVYHKQYMDELRRLWDTYKDDYFVDHKGKGVKNSEMRFVE

SEQ ID NO: 126 - DNA, 1233 bp, Lipomyces starkeyi
atgagtgagaaggcagagatcgaggttccgccgcaaaaatcgacattccctcgcagtgtgcacttcgctccacttcatattccactggagagacgcctacagactttggcagtcttattccacactgtcgcgctaccatactgcatcggtctgttctttctcatgctcgcgttccctcctttttggccattattggtaatgtatgtcatatacgcatacgggttcgaccactcgagctcgaacggagagatctcccgccggcgatcgccgctgtttcgaagactcccgttgttcaggctgtattgtgattacttccccatccacattcaccgggaggttccgctcgagccgacgtttcctggtcgccttcgcgaaccgagtggccttgtcgagcggtggattgcgaagatgttcggcgtgcaggacgctgttgtcgagggaaatgaatctgacgttaaggccacggccaacggcaatgggacgacgaaagaaatcggaccgacgtatgttttcggctatcatccgcatggaattgttagcttgggtgcgtttggtgctattggtacggaaggcgctggatgggagaagctctttcctgggatcccggtgtcactgctgactctcgaaacaaatttcagccttccattttacagagagtatttgctgtcacttgggattgcttcagtatctcgacggtcttgtaccaatctcctcaaacacgaccaatccatctgcatcgttatcggcggcgcccaagagtcgctcttagcggaaccaggcactctagatctgatcctcgttaaacgtcgcggttttgtcaaacttgcaatgtcaacggcgcgggtatctgaccaaccgatttgtcttgttccgatcctcagtttcggcgagaacgacgtgtacgaccaagtccgcggggaccgatcgtcgaagttgtataagatccagacttttatcaagaaagcggccgggtttacgctaccattgatgtatgcgcgcggtatatttaattacgactttgggctgatgccgtaccgcaggcaaatgacgctcgtggtcggcaagccgattgcagtgccgtacgtggcccagcctacggaggctgaaatcgaagtgtatcacaagcagtacatggatgaattgaggaggttatgggacacgtataaggacgactattttgtagaccacaagggcaagggggtcaagaattccgagatgcgttttgtggagtaa

SEQ ID NO: 127 - protein, 410 aa, Lipomyces starkeyi; identical to SEQ ID NO: 125

SEQ ID NO: 128 - DNA, 1233 bp, Lipomyces starkeyi
atgtccgagaaggctgagattgaggtgcccccccagaagtctactttccctcgatccgttcatttcgcccccctgcatatccccctggagcgacgactccagaccctggctgtgctcttccacactgttgccctgccttactgcatcggactcttctttctgatgctcgctttcccccctttttggcccctgctcgtgatgtacgttatctacgcctacggattcgaccattcctcttcgaacggcgagatctctcgacgacgatcgcctctgttccgacgactgcccctctttcgactctactgtgattacttccctatccacattcatcgagaggtccccctggagcctacctttcctggtcgactgcgagagccttccggactcgttgagcgatggattgctaagatgttcggtgtccaggacgccgtcgtggagggaaacgagtctgatgtgaaggccaccgctaacggaaacggcaccactaaggagatcggccctacttacgtcttcggataccacccccatggcattgtgtccctgggagcctttggcgctatcggtaccgagggtgctggatgggagaagctcttccctggtattcccgtctcgctgctcaccctggagactaacttctccctccccttttaccgagagtacctgctctctctgggaatcgcctcggtgtcccgacgatcgtgcaccaacctgctcaagcacgaccagtctatctgtattgttatcggaggtgctcaggagtccctgctcgctgagcctggaaccctggacctcattctggtcaagcgacgaggcttcgtgaagctggccatgtccactgctcgagtgtctgatcagcctatttgcctggttcccatcctctctttcggcgagaacgacgtttacgatcaggtccgaggtgaccgatcctctaagctgtacaagattcagaccttcatcaagaaggccgctggctttactctccctctgatgtacgcccgaggcatcttcaactacgactttggtctgatgccctaccgacgacagatgaccctcgttgtcggcaagcctattgccgtcccctacgtggctcagcccactgaggccgagatcgaggtctaccacaagcagtacatggacgagctgcgacgactctgggatacctacaaggacgattacttcgttgaccataagggcaagggtgtcaagaactctgagatgcgatttgtggagtaa

SEQ ID NO: 129 - protein, 380 aa, Aspergillus terreus
MPRNTHPPANNAGPNASHKKDRKRQGRLFQHTVPNKYSRIRWAPLNIGLERRLQTLVVLCHTLTIALFLAFFFFTCAIPLTWPLLFPYLVYITLFSTAPTSGTLKGRSDFLRSLPIWKLYTAYFPAKLHRSEPLLPTRKYIFGYHPHGIISHGAFAAFATDALGFSKLFPGITNTLLTLDSNFRIPFYREYAMAMGVASVSRESCENLLTKGGADGEGMGRAITIVVGGARESLDALPHTMRLVLKRRKGFIKLAIRTGADLVPVLAFGENDLYEQVRSDQHPLIYKVQMLVKRFLGFTVPLFHARGIFNYDVGLMPYRRPLNIVVGRPIQVVRQQDRDKIDDEYIDRLHAEYVRELESLWDQWKDVYAKDRISELEIVA

SEQ ID NO: 130 - DNA, 1143 bp, Aspergillus terreus
atgccccgaaacacccacccccccgccaacaacgccggacctaacgcctctcacaagaaggaccgaaagcgacagggacgactctttcagcacaccgttcctaacaagtactctcgaatccgatgggcccccctcaacattggcctggagcgacgactgcagaccctcgtcgtgctgtgccataccctcactatcgccctgttcctcgctttctttttctttacttgtgccattcccctgacctggcctctgctcttcccctacctcgtgtacatcaccctgttttcgaccgctcctacttccggtaccctgaagggacgatctgacttcctccgatcgctgcctatttggaagctctacactgcctactttcccgctaagctgcaccgatccgagcctctgctccctacccgaaagtacatcttcggctaccacccccatggtatcatttcccatggagccttcgccgcttttgccactgacgctctcggcttctctaagctgtttcctggtatcaccaacactctgctcaccctggattcgaacttccgaattcccttttaccgagagtacgccatggctatgggagtggcttccgtttctcgagagtcgtgcgagaacctgctcactaagggaggtgctgacggagagggaatgggccgagctatcaccattgttgtcggaggcgcccgagagtccctcgatgctctgcctcacactatgcgactggtcctcaagcgacgaaagggtttcatcaagctggccattcgaaccggagctgacctcgttcccgtcctggccttcggcgagaacgacctctacgagcaggtgcgatctgatcagcaccctctgatctacaaggtccagatgctcgtgaagcgattcctgggttttaccgtgcccctgttccatgctcgaggaatttttaactacgacgttggcctcatgccttaccgacgacccctgaacatcgtggttggtcgacccattcaggtcgtgcgacagcaggaccgagataagatcgacgatgagtacattgaccgactccacgccgagtacgtccgagagctcgagtccctgtgggaccagtggaaggatgtttacgccaaggaccgaatctctgagctggagattgtcgcttaa

SEQ ID NO: 131 - protein, 437 aa, Claviceps purpurea
MAAVQVARPVPPHHHDGAGREHKGERAHSPERGEKTVHNGYGLAETHEPLELNGSAVQDGKHDSDETITNGDYSPYPELDCGKERAAHEKEAWTAGGVRFAPLRVPFKRRMQTAAVLFHCMSIILISSCFWFSLANPITWPILVPYLVHLSLSNASTDGKLSYRSEWLRSLPLWRLFAGYFPAKLHKTFDLPPNRKYIFGYHPHGIISHGAWCAFATNALGFVEKFPGITNSLLTLDSNFRVPFYRDWILAMGIRSVSRESIRNILSKGGPDSNGQGRAVTIVIGGARESLEAQPGTLRLILQGRKGFIKVALRAGADLVPVIGFGENDLYDQLSPKTHPLVHKIQMFFLKVFKFTIPALHGRGLLNYDVGLLPYRRAVNIVVGRPIQIDETYGEQPPQEVIDRYHELYVQEVERLYAAYKEQFSNGKKTPELQILS

SEQ ID NO: 132 - DNA, 1314 bp, Claviceps purpurea
atggctgctgttcaggttgcccgacccgttcccccccaccaccacgatggcgctggccgagagcacaagggagagcgagcccattcccctgagcgaggagagaagaccgtccacaacggctacggtctggccgagactcatgagcccctggagctcaacggttctgctgtgcaggacggaaagcacgactcggatgagaccatcactaacggtgactactctccctaccctgagctcgattgcggaaaggagcgagccgctcatgagaaggaggcttggaccgctggaggtgtgcgattcgctcctctgcgagttccttttaagcgacgaatgcagactgccgctgtcctcttccactgcatgtccatcattctgatttcctcttgtttctggttttctctcgccaaccccatcacctggcctattctcgttccctacctggtccacctgtcgctctccaacgcttctactgacggcaagctctcctaccgatctgagtggctgcgatccctgcctctctggcgactgttcgccggttactttcccgctaagctccacaagaccttcgatctgccccctaaccgaaagtacatctttggttaccacccccatggaatcatttcccatggcgcctggtgtgccttcgctaccaacgctctgggcttcgttgagaagtttcctggtattaccaactcgctgctcactctcgactccaacttccgagtgcccttttaccgagattggatcctggccatgggcattcgatctgtttcgcgagagtctatccgaaacattctctcgaagggaggacctgactccaacggacagggccgagctgtgaccatcgttattggtggagcccgagagtctctggaggctcagcccggaactctgcgactcattctgcagggccgaaagggcttcattaaggtggctctccgagctggagctgacctggttcccgtcatcggtttcggagagaacgacctctacgatcagctgtcccctaagacccaccccctcgttcataagatccagatgttctttctgaaggtcttcaagtttactattcctgctctgcacggacgaggtctgctcaactacgacgtcggtctgctcccttaccgacgagctgtgaacatcgtcgtgggacgacccatccagattgacgagacctacggcgagcagccccctcaggaggtcatcgatcgataccacgagctctacgtccaggaggtggagcgactgtacgccgcttacaaggagcagttctcgaacggaaagaagacccccgagctccagatcctgtcctaa

SEQ ID NO: 133 - protein, 351 aa, Aurantiochytrium limacinum
MLAWMPVLIALPRRKQTAVVLLFVMLLPMIMVVYSWTLILLIFPLTTLPTLSYLIWIMYIDKSHETGKRKPFMRYWKMWRHFANYFPLRLIRTTPLDPRRKYVFCYHPHGIISLGAFGNFATDSTGFSRKFPGIDLRLLTLQINFYCPIIRELLLYMGLCSAAKKSCNQILQRGPGSAIMLVVGGAAESLDSQPGTYRLTLGRKGFVRVALDNGADLVPVLGFGENDVFDTVYLPPNSWARNVQEFVRKKLGFATPIFSGRGIFQYNMGLMPHRKPIIVVVGKPIKIPKIPDELKGRALSTTAEGVALVDKYHEKYVRALRELWNLYKEEYATEPKAAYLEPNSIRKNQNV

SEQ ID NO: 134 - DNA, 1056 bp, Aurantiochytrium limacinum
atgctcgcctggatgcctgtcctcattgccctcccccgacgaaagcagaccgctgttgttctcctgtttgtgatgctcctccctatgatcatggtcgtgtactcctggaccctgatcctgctcattttccccctcaccactctgcctactctctcctacctgatctggattatgtacattgacaagtctcacgagaccggaaagcgaaagccctttatgcgatactggaagatgtggcgacatttcgccaactactttcctctccgactgatccgaaccactcccctggaccctcgacgaaagtacgtgttctgctaccacccccatggcatcatttccctcggagccttcggcaactttgctaccgactcgactggcttctcccgaaagtttcccggtatcgatctgcgactgctcaccctccagattaacttctactgtcctatcattcgagagctgctcctgtacatgggtctgtgctctgccgctaagaagtcgtgtaaccagatcctccagcgaggacccggctctgctattatgctggttgtcggcggtgccgctgagtccctcgactctcagcctggcacctaccgactcactctgggtcgaaagggattcgtgcgagttgccctggacaacggtgctgatctggtccccgtgctcggtttcggagagaacgacgtgtttgataccgtttacctgccccctaactcgtgggcccgaaacgtccaggagttcgtgcgaaagaagctcggattcgctacccccatcttttccggccgaggtatttttcagtacaacatgggtctgatgccccaccgaaagcctatcattgtggttgtcggaaagcccatcaagattcccaagatccctgacgagctgaagggacgagccctctctaccactgccgagggcgttgctctggtcgataagtaccatgagaagtacgttcgagccctccgagagctgtggaacctctacaaggaggagtacgctaccgagcccaaggccgcttacctcgagcctaactcgattcgaaagaaccagaacgtctaa

SEQ ID NO: 135 - protein, 526 aa, Yarrowia lipolytica
MEVRRRKIDVLKAQKNGYESGPPSRQSSQPSSRASSRTRNKHSSSTLSLSGLTMKVQKKPAGPPANSKTPFLHIKPVHTCCSTSMLSRDYDGSNPSFKGFKNIGMIILIVGNLRLAFENYLKYGISNPFFDPKITPSEWQLSGLLIVVAYAHILMAYAIESAAKLLFLSSKHHYMAVGLLHTMNTLSSISLLSYVVYYYLPNPVAGTIVEFVAVILSLKLASYALTNSDLRKAAIHAQKLDKTQDDNEKESTSSSSSSDDAETLADIDVIPAYYAQLPYPQNVTLSNLLYFWFAPTLVYQPVYPKTERIRPKHVIRNLFELVSLCMLIQFLIFQYAYPIMQSCLALFFQPKLDYANISERLMKLASVSMMVWLIGFYAFFQNGLNLIAELTCFGNRTFYQQWWNSRSIGQYWTLWNKPVNQYFRHHVYVPLLARGMSRFNASVVVFFFSAVIHELLVGIPTHNIIGAAFFGMMSQVPLIMATENLQHINSSLGPFLGNCAFWFTFFLGQPTCAFLYYLAYNYKQNQ

SEQ ID NO: 136 - DNA, 1581 bp, Yarrowia lipolytica
atggaagtccgacgacgaaaaatcgacgtgctcaaggcccagaaaaacggctacgaatcgggcccaccatctcgacaatcgtcgcagccctcctcaagagcatcgtccagaacccgcaacaaacactcctcgtccaccctgtcgctcagcggactgaccatgaaagtccagaagaaacctgcgggacccccggcgaactccaaaacgccattcctacacatcaagcccgtgcacacgtgctgctccacatcaatgctttcgcgcgattatgacggctccaaccccagcttcaagggcttcaaaaacatcggcatgatcattctcattgtgggaaatctacggctcgcattcgaaaactacctcaaatacggcatttccaacccgttcttcgaccccaaaattactccttccgagtggcagctctcaggcttgctcatagtcgtggcctacgcacatatcctcatggcctacgctattgagagcgctgccaagctgctgttcctctctagcaaacaccactacatggccgtggggcttctgcataccatgaacactttgtcgtccatctcgttgctgtcctacgtcgtctactactacctgcccaaccccgtggcaggcacaatagtcgagtttgtggccgttattctgtctctcaaactcgcctcatacgccctcactaactcggatctccgaaaagccgcaattcatgcccagaagctcgacaagacgcaagacgataacgaaaaggaatccacctcgtcttcctcttcttcagatgacgcagagactttggcagacattgacgtcattcctgcatactacgcacagctgccctacccccagaatgtgacgctgtcgaacctgctgtacttctggtttgctcccacactggtctaccagcccgtgtaccccaagacggagcgtattcgacccaagcacgtgatccgaaacctgtttgagctcgtctctctgtgcatgcttattcagtttctcatcttccagtacgcctaccccatcatgcagtcgtgtctggctctgttcttccagcccaagctcgattatgccaacatctccgagcgcctcatgaagttggcctccgtgtctatgatggtctggctcattggattctacgctttcttccagaacggtctcaatcttattgccgagctcacctgttttggaaacagaaccttctaccagcagtggtggaattcccgctccattggccagtactggactctatggaacaagccagtcaaccagtactttagacaccacgtctacgtgcctcttctcgctcggggcatgtcgcggttcaatgcgtcggtggtggttttctttttctccgccgtcatccatgaactgcttgtcggcatccccactcacaacatcatcggagccgccttcttcggcatgatgtcgcaggtgcctctgatcatggctactgagaaccttcagcatattaactcctctctgggccccttccttggcaactgtgcattctggttcacctttttcctgggacaacccacttgtgcattcctttattatctggcttacaactacaagcagaaccagtag

SEQ ID NO: 137 - protein, 697 aa, Rhodosporidium toruloides
MTERSLPVTLPLPRNFALTPHQMASPDPPLPGPANLVDDALRHPDSAPPISPDSAPPSTATRPSALSRGELSTASSYASEVSTREGTPDLANGQGVTTTITTVTGKGGKAVTQTLTHVGAASVDARFSSTTNSITLRPIPARGGDPKKIKVLRSRRTHFAPRTSHFDRHNLTSASDPFRGLYTLFWIVIFVGALKTVYHRFAEQGGWGGEWRFAALISRDGWVLAVSDAVLVSASLLCVPYAKLLVHGWIRYHGAGVIIQHICQTLYLAIAIRWTFHRNWPWVQSGFMTLHALSMLMKIHSYCSLNGELSERRRQLKKDEKRLEEVLEEMGGRRKAEREAREEWERQCGEAARAKEGEAGVSEGEKEAAATLSSTDASNSALSSEDEAAAALLRHRQPTARRRSISPSASRTGSSSAPSATLAPSRAEEPQEGVETLTWHPSDQVSKLAIAICEAKDLLTSNGKKPVTFPENVTFANFIDYLLVPTLVYELEYPRTDSIRPLYILEKTLATFGTFSILVLIVDSFILPVTSRTDTPLFGFVLDLALPFTLAYLLIFYVIFEGVCNGFAELTRFADRNFFDDWWNSCTFDEFSRKWNRPVHAFLLRHVYAETMASYKLSKLSAAFVTFLFSACVHELVMAVVTKKLRLYLFSMQMAQLPLIMVGRAKIFRQYPALGNLFFWLALLSGFPLLGTLYLRY

SEQ ID NO: 138 - DNA, 2094 bp, Rhodosporidium toruloides
atgacggagcgatcccttccagtgacgctccctcttcctcgaaactttgcgctcacaccgcaccagatggcctcgccagacccgccactcccaggcccagccaacctcgtcgacgacgcactccgacacccagactcggcgccgcccatctcgcccgactccgcgcctccttcgactgcgactcggccctctgctctctcgcgcggagagctctcgaccgcttcgagctacgcgagcgaggtgtcgacgagggaggggacaccggatctggcgaatgggcaaggggttacgacgaccatcacgactgtcacaggcaaaggcggaaaggccgtcacccagaccctcacccacgtcggcgccgcctccgtcgacgcccgcttctcctccaccacaaactccatcactctccgccctatccccgcccgtggcggcgacccgaaaaagatcaaagtcctccgctctcgtcggacccacttcgccccacgcacctcacacttcgaccgtcacaacctcacctccgcctctgacccgttccgcggactgtacacgttgttctggatcgtgatcttcgttggggcactcaagactgtgtatcatcggtttgcggaacagggtgggtggggtggagaatggaggtttgcggcgttgattagtcgcgatgggtgggttctggcggttagtgatgcggtgttggttagcgcgtcgttgttgtgcgtgccgtatgcaaagctcctcgtacacggctggatccggtaccacggcgcaggcgtcatcatccaacacatctgtcaaacgctctacctcgccatcgcgatccgctggaccttccaccgcaactggccctgggtccaaagcggtttcatgaccctccacgccctctcgatgctcatgaagatccatagctactgttctctgaacggcgagctttcggagcggcggagacagttgaagaaggacgagaagcggttggaggaggtgctggaggagatgggtggacggaggaaggcggagagggaggcgagggaggagtgggagaggcagtgtggggaggcggcgagggccaaggagggtgaggcgggagtgagcgagggggagaaggaggcggcggcgactctatcttcgacggatgcgtcgaattcggccctttcgtcggaggacgaggcggctgcggcgctgttgcggcatcgacagccgactgctcgacgacgatccatctcgccctctgcctcacgcaccggttcctcctccgccccctccgctaccctcgccccctctcgcgccgaagaaccccaagaaggcgttgagacgctcacctggcacccatccgaccaagtcagcaaactcgctatcgccatctgcgaggcaaaggacctcctcacgagtaacggcaagaagcccgtcacgttccccgagaacgtcacctttgcgaactttatcgactacttgcttgtgccgacgttggtgtacgagttggagtaccctcggacggattccatccggcccctctacatcctcgaaaagaccctcgcaaccttcggcaccttctccattctcgtcctcatcgtcgactcgttcatcctccccgtcacctcgcgcaccgacacgcccctcttcgggttcgtcctcgacctcgccctgccgttcacgctcgcgtacctcctcatcttctacgtcatctttgagggcgtgtgcaatgggtttgcggagttgacgaggtttgcggatcggaatttcttcgacgattggtggaactcgtgcacgttcgacgagttctcgcgcaagtggaatcgccccgtccacgccttcctcctccgccacgtttacgccgaaacgatggcttcttacaagctctcgaagctctcggctgcgttcgtcacgttcttgttcagcgcctgcgtgcacgaactcgtcatggcggtcgtgacgaagaagcttcggctgtacctgttctcgatgcagatggcccagctcccgctcatcatggtgggccgcgccaagatcttccgacagtatccagcgctcggcaacctcttcttctggctcgcccttctctcgggattcccgcttctcgggacgctgtatctgcggtactga

SEQ ID NO: 139 - protein, 555 aa, Lipomyces starkeyi
MSTAAQSDTDNEDISTVDLVDSRADTHTSSNVMLQQQKSRRRLIGKDAEPRTQHPSGGKSEKEELTKPDDSKGPIKLSHIYPIHAVSRGSILSRESTTPTPSFVGFRNLAMIVLGKLQYSLFFWCDRANIPTAVSNLRLVIENYSKYGVLIRFARLGISQKDILYCIFLTATIPLHLFIAIVIERLVAIPTVNYVASLSESEDKKRSNPKMGRKGGSISILRPKPKYMWRLIVLLHSINAMACLWVTTVVVYNSIYHPLIGTACEFHAVIVCLKVASFALTNRDLRESMLNSQPVPAIYNLAPYPKNLTLKNLSYFWWAPTLVYQPVYPRSPSFRPLFFVKRILEMVGLSFLIWFLSAQYAVPTLENSLVHFHSLQFMGIMERLMKLASISMAIWLAGFFCIFQSGLNALAEVMRFGDRAFYDDWWNSKSVGEYWRLWNKPVTNYFRRHIYVPLVRRGWNSATASVMVFFVSAVLHELVVGVPTHNVIGVAFSSMILQIPLIQVTAPLEKMHGPTSGIIGNCIFWFSFFIGQPLGVLLYYFAWNVSMSKVKMVES

SEQ ID NO: 140 - DNA, 1668 bp, Lipomyces starkeyi
atgtcgaccgctgcacaatctgatacagacaacgaggatatatcgactgtcgatttggttgactctcgtgcagatactcacacatcttcaaatgttatgttgcaacagcaaaaatcgcgtcggagactaatcgggaaagacgccgagccaagaacacagcatccgtctggaggcaaatcggagaaggaggagttgacgaagccggatgactcaaagggacccataaaattaagtcacatatacccgatacatgccgttagccgaggcagtattctgtcacgagagtcgacaactcctacaccgagttttgttgggtttcgaaacttagccatgatagtgctagggaagttacagtattcattattcttttggtgcgatcgggctaacattccgacagccgtcagcaatcttcgattggtgattgaaaattactcaaagtacggcgttctgatccgattcgcccgactcggtatttcacaaaaggacattctgtattgcatattcttgaccgctaccatcccgctgcacctatttattgctattgtcattgaaagactagttgcgattccgacggtaaactacgtcgcttcgctcagcgagagcgaggataaaaaacgctccaaccccaaaatgggacggaaggggggcagtatatcgattttgcgtcctaagccaaaatatatgtggcgcctgatcgtcctattgcattcaataaacgcaatggcttgcttgtgggttacgactgttgttgtttacaattctatttatcatccccttattgggacagcttgtgaatttcatgcagtgattgtgtgtcttaaggtcgcatcgtttgcgcttaccaatcgcgatcttcgggagtcgatgctgaactctcaacctgtgccagccatatacaacttggccccttatccaaaaaacttaaccctcaagaacttgtcatacttttggtgggcgccgactcttgtttatcaacctgtctatccgcgatcgccttcattccggcctttgttttttgtcaagcggattctggagatggtgggcctatcatttttaatatggttcttgtcagctcaatatgctgtgccgacgctagaaaatagtttggtgcattttcacagtttgcaattcatgggaattatggagcgactcatgaagcttgctagcattagcatggctatttggcttgctggttttttctgcatttttcagtctggactcaatgcgcttgcggaggtaatgcggtttggtgacagagccttttacgacgactggtggaacagcaaatctgtgggagagtattggcgtctgtggaataagccggttacgaattacttccggcgtcatatttacgtaccgcttgtgcgccgcgggtggaattctgcgacagccagtgtcatggtatttttcgtcagcgcggtgttgcatgagctagttgttggagttccgacgcataacgtaattggagttgcattctcgtcgatgattctacaaatcccactcatacaagtaaccgcgcctctggagaagatgcatggacctacatctggaataatagggaactgtatcttttggtttagcttcttcatcggtcagcctctgggcgtgctactttactattttgcgtggaacgttagtatgagcaaagtaaagatggtcgagagctag

SEQ ID NO: 141 - protein, 517 aa, Aspergillus terreus
MVMDTQTTASATSTALTTDHTVASRTSRSEPNGGVHNVSSPPTSEPTGGNGGGRRRSKYRHVAAYHSEVRHSSLSRESNTSPSFLGFRNLMVIVLGECPSALLRFVNPTENSYGSRLVAMNLRLVIENYVKYGVLICIRCHDYRKQDVVLGSMLFALVPCQLFIAYLLELAAAGRAKQTVGRKKKDGSAEEGEREARAFRHIWRFALSFHILNIVLNLAVTSFVVYYYIHHPGIGTLCEVHAIVVALKNWSYAFTNRDLREAMLNPSAESALPEIYSSLPYPKNITLGNLTYFWLAPTLLYQPVYPRSPSIRWPFVAKRLSEFACLSVFIWLLSAQYAAPVLRNSIDKIRDMAYASIFERVMKLSTISLVIWLAGFFAIFQSLLNALAEIMKFGDREFYTDWWNSPSLGVYWRSWNRPVYQFMKRHVYSPLIGRGYSPFVASTVVFTISALLHELLVGIPTHNMIGVALVGMLFQLPLIAITAPLEKMKDPLGKPLGALLYFFAWQAKYGSVSRMGN

SEQ ID NO: 142 - DNA, 1554 bp, Aspergillus terreus
atggtgatggacacacaaaccacagcatccgccaccagcacggcgctcacgaccgaccacactgttgcctctcggacgtcccgctctgagccgaacggtggtgtgcataatgtatcgtcacctccaacgagcgaaccgactgggggaaatggcggaggccggcgaaggagtaaataccggcatgtcgcagcgtaccattccgaagtgcgccattccagtctcagtcgggaatcgaatacttctccgagtttcctcggattccggaacctcatggtaatcgtattaggtgagtgccctagtgctctcctacgttttgtgaacccgacggagaactcatacgggtcgcgactagttgctatgaatcttcgattggttatcgagaattacgtgaagtatggggtcttgatctgcatcagatgccacgattatcgaaagcaggacgttgtcctgggctcaatgttatttgctctcgtcccatgccagctattcatcgcctacctcctggaattggccgcagcgggtagggccaaacagactgtgggccgaaagaaaaaggacggatcagccgaggagggcgaacgtgaagcacgtgcttttcgacacatctggcggtttgcattgtcctttcacatcctcaacattgttctcaatctcgccgtcacgagcttcgttgtgtattactacatccaccatcccggcattggtacgctctgtgaagtgcatgcgatcgttgtcgcgttgaaaaactggtcctatgcgttcaccaatcgggatctgcgagaggcgatgcttaatccctcggcggagtcggcgcttcccgagatctattccagcctcccgtacccgaaaaacatcacgttaggaaatctaacgtacttctggcttgcaccgacactgttgtatcagccagtataccccaggtcgccttccatccgatggccattcgtggccaaacgcttgtcggaatttgcgtgcttgtcggtgttcatttggctactttcggcccaatacgctgcgccagttttgcgcaactccattgacaagattcgtgatatggcatatgcatccatttttgagcgcgttatgaagctatccaccatctctctcgtcatttggctggctgggttctttgcgattttccaatcactcttgaatgctttggcggagatcatgaagtttggcgatcgggaattctacaccgattggtggaatagcccaagtctcggtgtttactggcggtcatggaatcggccagtgtaccagttcatgaagcggcacgtatattctccgttgatagggcgggggtacagcccgtttgtggcaagcactgtcgtattcaccatctccgctctccttcatgagctcctcgtggggatacccacgcacaacatgataggcgtcgcgcttgttggaatgctgttccagctcccgttgatcgccatcactgccccattggaaaagatgaaagatccattgggtaagcccctgggagcactgctgtatttctttgcctggcaggcaaaatatggcagtgtgagcaggatgggcaactga

SEQ ID NO: 143 - protein, 506 aa, Claviceps purpurea
MSATGVDVANGRSGARRRNDTAVDETISAVTAEMRSSSHPTYRHVSAVHSTSRPSCLSHDSDAAPSFIGFRNLMVIVLVVGNVRLMIENLKKYGVLICLRCHSYKNEDIIIGGLLYFLIPCHLLVAYGIELAAARQARESRTRPPGQSDTASKSTEDDNKHFHSTWVLAAWAHIINMTLSFILTTFVVYYYVHHPLVGTLTEMHAVIVSLKTASYAFTNRDLRHAYLHPDKRKHIPELYLECPYPQNLTFGNLVYFWWAPTLVYQPVYPRTDKIRWVFVFKRLGEVCCLSAFIWFASFQYAAPVLRNSLDKIASLDFIMIFERLLKLSTISLVIWLAGFFALFQSFLNALAEVLRFGDRCFYDDWWNSESLGAYWRTWNRPVYTYFKRHVYVPMIGRGWSPWTASCTVFFVSAVLHEVLVGVPTHNIIGVAFVGMFLQLPLIALTAPMEKKKWGHTGRVMGNVIFWVSFTIFGQPFAALMYFYAWQAKYGSVSRQIVLVNPVEEAS

SEQ ID NO: 144 - DNA, 1521 bp, Claviceps purpurea
atgtccgccacgggcgttgatgtggccaacggccgcagcggcgcgcgacgacgcaacgatactgccgtcgacgagactatatccgccgtcacggccgagatgcgttcctcgtcgcatccaacataccgccatgtgtctgctgtgcactccacgagccggccctcgtgtctgagccatgattctgacgctgcgccgagcttcattggctttcgaaatctcatggtcattgttctggtcgttggcaatgttcgattaatgattgaaaatctaaaaaagtacggcgtactgatatgcctccgatgtcactcgtataaaaacgaagacatcattatcggcggactgctctacttcctgatcccctgccacttgcttgtcgcctacggaatcgagttagccgccgccagacaagcacgcgaatctcgaactcgtccaccaggccagtccgacacggcgtcgaaatcaacagaagatgacaacaagcacttccactcaacatgggtgctcgctgcctgggcacacatcatcaacatgacactttccttcatcctcaccaccttcgtcgtctactactacgtgcaccatcccctcgtcggcaccctgaccgagatgcacgccgtcatcgtctctctcaaaacagcttcctacgcattcaccaaccgagatcttcgccacgcatacctccatcctgacaagcgcaagcacatccccgagctatatctcgaatgtccctacccccagaacctcacctttggcaatctcgtgtatttctggtgggcccccacgctggtataccagcccgtgtatccgcgcaccgacaagatcagatgggtttttgtttttaaaagactaggcgaagtctgctgtctcagcgcattcatctggttcgccagcttccagtacgccgcgcccgtgttgcggaactccctggacaagattgcgtctctcgacttcatcatgatctttgagcgccttctcaagctatccaccatttctctcgtcatctggctcgccggcttcttcgccctgttccagtctttcctgaatgccctggctgaggtattgcgctttggggaccggtgcttctacgacgattggtggaatagcgagagtctgggggcgtattggaggacgtggaacaggcctgtgtatacctacttcaagcgccatgtgtatgtgcccatgattgggaggggatggagtccctggactgctagttgtactgttttttttgtgtcggcggtgctgcacgaggttcttgttggggtgcccacccacaatatcattggtgtcgcctttgtgggcatgtttctgcagcttcccctaatagccctcaccgctcccatggaaaagaagaaatggggccacaccggccgtgtgatgggcaatgttattttctgggtgtcctttacaatctttgggcagccctttgcagcgctcatgtacttttatgcctggcaggccaagtacgggagcgtgagtcggcaaattgtgctggtgaatccggtggaggaggcgtcttga

SEQ ID NO: 145 - protein, 551 aa, Chaetomium globosum
MKAETGTTMATSTSLETSQVNGVTNRAPVGPSHDPHATTPTHETTTTIPSDVLANGSTNGTTNGTTDDSLDISELRKAFRNKYRHVEAVHSESKPSCLSHDATETPSFIGFRNLMVIVLVAANLRLVIENIQKYGVLICIKCHDFRPNDVRLGLLLYILIPWHLMLAYLIELVAAANARNSRAKAKKRDGSTSPTEDESKQFLQTWRMLRILHAVNVTAALAVTSYVVYYYIHHPLIGTLSELHAIIVWLKTASYALTNRDLRHAYLHPVRGERDALPEIYAQCPYPANVTFSNLTYFWWAPTLVYQPAYPRTQRIRWVFVAKRLGEVVCLSAFIWFASAQYATPVLRNSLDKIATLDYMSIVERLLKLSTISLVIWLAGFFALFQSFLNALAEVMRFGDREFYEAWWNSESLGAYWRTWNKPVYQFFRRHVYSPMRSRGWSHLSASLAVFLLSAVLHELLVGVPTHNIIGVAFLGMFLQLPLIAMTARLGGRRGNTAHGRLLGNTIFWVSFTIFGQPFAALMYFYAWQAKYGSVSKMPLAQPGTCPAVVV

SEQ ID NO: 146 - DNA, 1656 bp, Chaetomium globosum
atgaaggcagaaacgggcacaacgatggcaacgtcgactagtctcgagacttcccaagtcaatggcgtcaccaaccgggcccctgttggccctagtcacgacccccacgctacaactccgactcatgagacgacaaccaccataccgtccgacgtcctcgccaatggttctacaaatgggactacgaatgggacgacagatgattcattggacatatccgaattgcgcaaagcgttccgcaacaagtatcgccatgtcgaggctgtccactccgaatcgaaaccatcctgtctgagccatgacgctacagagacacccagtttcatcggttttaggaatctcatggtgattgtgttggttgctgccaatcttcgcctggtcatcgagaacattcaaaagtatggagttctgatctgcatcaaatgccacgactttcgccccaacgatgtacgcctggggctcctcctctacatcctgatcccatggcacctcatgctcgcctacctcattgagctggtcgccgccgccaatgcccgcaactcccgggccaaggcgaagaagcgggacggcagtaccagcccgaccgaagacgagtccaagcaattcctgcagacctggcggatgctccgcattctccacgccgtcaacgtcacggccgccctggccgtcacctcctacgtggtctactactacattcaccacccgctgatcggcacgctctcggagctgcacgccatcatcgtgtggctcaagacggcgtcgtacgcgctcaccaaccgcgacctgcgccacgcctacctacacccggtgcgcggcgagcgcgacgctctgcccgagatctacgcccagtgcccctacccggccaacgtgaccttctccaacttgacctacttctggtgggcgcccaccctggtgtaccagccggcgtacccgcgcactcagcgcatccgctgggtctttgtggctaagcgcctcggcgaggtcgtctgcttgagcgccttcatctggttcgccagcgcccagtacgctacccccgtgctgcgaaactcgctcgacaagatcgctaccctggattacatgtccattgtcgagcgtctgttgaagctgtcgaccatctcgctggtcatctggctggcgggcttctttgcgctgtttcagagtttcctgaatgccttggccgaggtgatgcggtttggagaccgcgagttctacgaagcatggtggaacagcgaaagcctcggcgcctactggcgcacctggaacaaacccgtgtaccaattcttccggcggcacgtctactcgccgatgcggtcgcgcgggtggagccacttgtcggccagcctcgccgtgtttctgctctcggccgtgctacacgagctgctggtgggggtgccgacgcacaacatcatcggcgtcgccttcctgggcatgttcctgcagctgccgctcatcgccatgacggcgcgcctgggcggccgccgcgggaacaccgcccacggccgcctgctcggcaacactatcttttgggtgtcatttaccatttttggccagccgtttgccgcgctgatgtatttttatgcatggcaggccaagtatggtagtgtgagcaagatgccgctggcgcagccggggacgtgtccggctgtggttgtttga

SEQ ID NO: 147 - protein, 666 aa, Yarrowia lipolytica
MKSRVAVVLAPVLAPFVAILKNLWVFFTALLELLFDVSWHWMLQSWHWWCSTDQKTLLQLQLDQADTYEEWESIASELDELLGNDVWRQTAASKRYDYRLIAGRLRDFIECRAVGDIATLISRLRSGLLRNLGSISSLQLYTRSYLGSKLLIEEYITEVIDCLKYIKDYGTTGGLDTKGVHFFPKSEQRQLDSEQLTRQKKHKLFYDTRQSFGRTALVLQGGTIFGLTHLGTIKALTLQGLLPGIVTGFKEGAFIAALTGIYVSDLELLETIDSLPDTLNDLYQKYKERLAEENKHKDHSFSNSNSDYDFDYAFDFEQFANTYNVTFSSVTDKVLRSEYPPEVKMYEEFIENQLGDLTFEEAFNKSDRVLNIVAHSHDSSFPTLMNYLTTPNVLIRSACRASMVTAHDEPQTKKACAHLLVKDDDNSVIPYDACKSRRGSSTDVILGPVQEEVDPLDSTANGTNSSGPPKLEITTDTWKRNNADDEDHVDTLPGRVSALPTPSYSMINQGKIVSPYARLSELFNVNHFIVSLSRPYLAPLLAIEGRHRGYHGWRVNLIRVLKLEFEHRLAQFDYIGLLPTIFRRFFIDDKIPGIGPNAEVLIVPELAAGMISDFKKAFSNHDIPEKVRYWTTVGERATWPLVAAIWARTAIEYTLNDMYNQTKRQN

SEQ ID NO: 148 - DNA, 2201 bp, Yarrowia lipolytica
cttttacgagtgtgtatcatcacatgattatgcagcaagatcagtatcatttcggctatccagctctcttcccccgttcagctccttttctaccgcgattatgaaaagccgcgtggccgttgtcttggcgccggttctggcaccatttgtggcgattttgaaaaacctgtgggtcttcttcacagctctactggagctcttattcgacgttagctggcactggatgttacaatcatggcactggtggtgctccaccgaccaaaaaacactgctacaactgcagctggaccaggcagacacctacgaggaatgggaaagcattgcatcggagctggacgagctgctgggcaacgacgtgtggcgtcagaccgcagcctcgaaacgatacgactaccggctgattgcaggccgtctgagagactttatcgagtgccgggcggtcggcgacattgcgacgctgatttctcgtctgcgaagcggactgctgcggaatttgggctcgatttcgtcgctccagctgtacactcgctcgtacctcggctctaaactgctcatcgaagagtacatcaccgaggtcattgactgtctcaagtacatcaaggactatgggacgacgggcggactggacaccaagggagtgcatttcttcccaaagtccgaacagcgacaactggacagtgaacagctgactcgacaaaagaaacacaagttattctacgacacacgacaatcttttggccgaacggccctcgtgttgcagggaggaactattttcggacttactcatctcggaacaatcaaggctcttactctccagggtctgctaccgggtattgtcaccggtttcaaggagggggcgtttattgccgctctcacaggcatctacgtatccgacctggagctgctcgaaaccattgactctttgccagacactctcaatgacctgtaccaaaaatacaaggagcgactggcggaggaaaacaaacacaaggaccactcgttcagtaactccaattcggactacgactttgactacgcatttgactttgaacagtttgcaaacacctataatgtgaccttctcgtctgtcactgacaaagtattgcgatcggagtaccccccggaagtcaaaatgtacgaggagttcatcgagaatcaactcggagacctcacgttcgaagaggccttcaacaaaagcgaccgcgtgctcaacattgtcgcccattcccatgactcttccttcccgacactgatgaactacctcaccactcccaatgtgctcatcagaagcgcatgtagagcttccatggtgaccgcccacgacgagccccaaacgaaaaaggcatgtgcccatctgctggtcaaggatgacgacaacagcgtcattccctatgacgcctgcaaatccaggcgaggaagctcgaccgacgtgattctgggacctgtccaggaggaggtggatccattagattcaacagctaacggtactaactcttctggacctcccaaactcgaaatcacaactgacacctggaaacgaaacaatgcagacgacgaggaccacgtggatactctcccgggccgcgtgagtgctctacctacaccttcgtactccatgattaaccagggcaagattgtctctccctacgctcgcctttccgaactctttaacgtcaaccacttcatcgtctctctctcaagaccctacctggcgcctcttctggccatcgaaggccgacatagaggctaccacggctggagagtgaacctgatccgagtactgaaactagaattcgaacacagactcgcccagttcgactacataggcctgctgccgaccatcttccgtcggttcttcatcgacgataagatccctggcatcggtcccaacgccgaggtgctcattgttcctgagctagcggctggcatgatctccgacttcaaaaaggccttttcgaaccacgacattcccgagaaggtccgctactggaccactgtgggcgaacgagccacctggcctctagtcgccgccatctgggccagaacagcaatcgagtacaccctcaacgacatgtacaaccagaccaagcgacaaaactagaccccgagcagagcacataactactaacgatgagactaaagtatgtactgtatgtactaaacatacgctcgtaaacagttgtatttattctttttcagca

SEQ ID NO: 149 - protein, 612 aa, Yarrowia lipolytica
MFRTIRKPAWAAAAAVAAAGAGAVALSVPAQAQEELHKKHKFTVPPVAAEPPSRAAQLEKMKTEEFDLVVVGGGATGSGIALDAVTRGLKVALVERDDFSCGTSSRSTKLIHGGVRYLEKAVWNLDYNQYELVKEALHERKVFLDIAPHLTFALPIMIPVYTWWQLPYFWMGVKCYDLLAGRQNLESSYMLSRSRALDAFPMLSDDKLKGAIVYYDGSQNDSRMNVSLIMTAVEKGATILNHCEVTELTKGANGQLNGVVAKDTDGNAGSFNIKAKCVVNATGPFTDSLRQMDDKNTKEICAPSSGVHIILPGYYSPKKMGLLDPATSDGRVIFFLPWQGNTLAGTTDQPTKITANPIPSEEDIDFILNEVRHYVEGKVDVRREDVLAAWSGIRPLVRDPHAKNTESLVRNHLITYSESGLVTIAGGKWTTYRQMAEETVDACIAKFGLKPEISAKAVTRDVKLIGAKDWTPLTYIDLIQQEDLDPEVAKHLSENYGSRAFTVASLAEMPTPEPGVIPQSTLTKGKRILYPYPYLDAECKYSMKYEYATTAIDFLARRTRLAFLNAAAAYEALPEVIEIMAKELQWDEARKEQEFNTGVEYLYSMGLTPKDK

SEQ ID NO: 150 - DNA, 2039 bp, Yarrowia lipolytica
ccatttaaaattcaaacaaagcgcaccaccgcaaagcatacttaacccactcaatgtagacgtcgcggaacttctctttcctacccaccaccccaaacaaatgttcagaaccattcgaaaacccgcgtgggctgctgccgccgccgtggcagccgctggcgctggagccgtcgccctgtctgtgcctgcccaggcccaggaggagctccacaagaagcacaaattcacagtgccccccgtggccgccgagcccccctctcgagccgcccagctcgagaagatgaagaccgaggagtttgatctcgtcgttgttggtggaggagctaccggatccggtatcgccctcgacgctgtcacacgaggcctcaaggttgctctggtcgagcgagacgatttctcctgcggaacctcgtcccgatccaccaagctcatccacggaggtgtccgatacctcgagaaggctgtgtggaacctcgactacaaccagtacgagctggtcaaggaggccctgcacgagcgaaaggtcttcctcgacattgctccccacctcacctttgctctgcccatcatgatccccgtctacacctggtggcagcttccctacttctggatgggtgtcaagtgctacgatctgcttgccggccgacagaacctcgagtcctcttacatgctctcccgatcccgtgctctcgatgccttccccatgctttccgatgacaagctcaagggcgccattgtctactatgatggctcccagaacgactctcgaatgaacgtttctcttattatgactgctgttgagaagggtgccaccatcctgaaccattgcgaggtcaccgagctcaccaagggcgccaatggccagctcaacggtgttgttgccaaggatactgacggaaacgctggatccttcaacatcaaggccaagtgtgtcgttaatgctactggacccttcactgactctctgcgacagatggacgacaagaacaccaaggagatctgtgctccttcctccggtgttcacatcattctccccggttactactcccccaagaagatgggactccttgaccccgctacttctgacggccgagttatcttcttcctcccctggcagggaaacacccttgccggtactactgaccagcctaccaagatcactgctaaccctatcccctccgaggaggacattgacttcattctcaacgaggtccgacactacgttgagggcaaggttgatgtgcgacgagaggacgttctggccgcctggtccggaatccgaccccttgtccgggacccccacgccaagaacaccgagtctcttgtccgaaaccatctcatcacctactccgagtctggtcttgtcaccattgctggcggaaagtggaccacttaccgacagatggctgaggagactgtcgatgcctgcattgccaagttcggtctcaagcctgaaatctccgccaaggccgtcacccgagacgtcaagctcatcggtgctaaggactggactcctctcacttacattgatctgatccagcaggaggaccttgaccccgaggttgctaagcacctttctgagaactacggatctcgagctttcaccgttgcttctcttgctgagatgcccacccccgaacccggtgtgatcccccagtctactctcacaaagggtaagcgaatcctgtacccctacccctacctcgatgccgagtgcaagtactctatgaagtacgagtatgccaccaccgccatcgacttccttgctcgacgaactcgtcttgctttccttaacgccgctgccgcctacgaggctctccctgaggtcattgagatcatggccaaggagctccagtgggacgaggctcgaaaggagcaggaattcaacaccggtgtcgagtacctctactccatgggccttacccccaaggacaaataactgtatagtaaaagcgtatagccaataagataatcacttgaatgaaggagcagcaactcgtatgtttagcacttcaacggactatttccccgcagcaaag

SEQ ID NO: 151 - protein, 341 aa, Escherichia coli
MKKPELTATSVEKFLIEKFDSVSDLMQLSEGEESRAFSFDVGGRGYVLRVNSCADGFYKDRYVYRHFASAALPIPEVLDIGEFSESLTYCISRRAQGVTLQDLPETELPAVLQPVAEAMDAIAAADLSQTSGFGPFGPQGIGQYTTWRDFICAIADPHVYHWQTVMDDTVSASVAQALDELMLWAEDCPEVRHLVHADFGSNNVLTDNGRITAVIDWSEAMFGDSQYEVANIFFWRPWLACMEQQTRYFERRHPELAGSPRLRAYMLRIGLDQLYQSLVDGNFDDAAWAQGRCDAIVRSGAGTVGRTQIARRSAAVWTDGCVEVLADSGNRRPSTRPRAKE

SEQ ID NO: 152 - DNA, 1026 bp, Escherichia coli
atgaagaagcccgagctgaccgctacctctgttgagaagttcctgattgagaagtttgattccgtttccgacctgatgcagctgtccgagggcgaggagtctcgagccttctcctttgacgtgggcggacgaggttacgttctgcgagtgaactcgtgtgccgacggcttctacaaggatcgatacgtctaccgacactttgcttctgccgctctgcccatccctgaggttctcgacattggcgagttctctgagtccctcacctactgcatctctcgacgagctcagggagtcaccctgcaggacctccctgagactgagctgcctgctgtcctccagcctgttgctgaggccatggacgctatcgctgctgctgatctgtcccagacctcgggtttcggcccctttggacctcagggaattggacagtacaccacttggcgagacttcatctgtgctattgccgatcctcacgtctaccattggcagaccgttatggacgatactgtgtcggcttctgtcgctcaggctctggacgagctgatgctctgggccgaggattgccccgaggttcgacacctggtgcatgctgacttcggttccaacaacgttctcaccgacaacggccgaatcactgccgtgattgactggtccgaggctatgtttggcgactcgcagtacgaggtggccaacatcttcttttggcgaccctggctggcttgtatggagcagcagacccgatacttcgagcgacgacatcctgagctcgctggatcccctcgactgcgagcttacatgctccgaattggtctggaccagctctaccagtcgctggtggatggcaactttgacgatgctgcctgggctcagggacgatgtgacgccatcgtgcgatctggcgctggaaccgtcggacgaactcagattgcccgacgatccgctgctgtctggaccgacggatgcgtggaggtcctggctgattcgggtaaccgacgaccctctactcgacctcgagctaaggagtaa

SEQ ID NO: 153 - DNA, 24 bp, Artificial Sequence
  Description of Artificial Sequence: Synthetic primer
accacttggcgagacttcatctgt

SEQ ID NO: 154 - DNA, 24 bp, Artificial Sequence
  Description of Artificial Sequence: Synthetic primer
agcatcgtcaaagttgccatccac

SEQ ID NO: 155 - DNA, 20 bp, Artificial Sequence
  Description of Artificial Sequence: Synthetic primer
cctccggtcgattatgcctc

SEQ ID NO: 156 - DNA, 71 bp, Artificial Sequence
  Description of Artificial Sequence: Synthetic primer
tcaatgtagacgtcgcggaacttctctttcctacccaccaccccaaacaaatgaagaagcccgagctgacc

SEQ ID NO: 157 - DNA, 60 bp, Artificial Sequence
  Description of Artificial Sequence: Synthetic primer
cagctctcttcccccgttcagctccttttctaccgcgattatgaagaagcccgagctgac

SEQ ID NO: 158 - DNA, 60 bp, Artificial Sequence
  Description of Artificial Sequence: Synthetic primer
tttagtctcatcgttagtagttatgtgctctgctcggggttactccttagctcgaggtcg

SEQ ID NO: 159 - DNA, 61 bp, Artificial Sequence
  Description of Artificial Sequence: Synthetic primer
caagtgattatcttattggctatacgcttttactatacagttactccttagctcgaggtcg

SEQ ID NO: 160 - DNA, 898 bp, Yarrowia lipolytica
cagctctcttcccccgttcagctccttttctaccgcgattatgaagaagcccgagctgaccgctacctctgttgagaagttcctgattgagaagtttgattccgtttccgacctgatgcagctgtccgagggcgaggagtctcgagccttctcctttgacgtgggcggacgaggttacgttctgcgagtgaactcgtgtgccgacggcttctacaaggatcgatacgtctaccgacactttgcttctgccgctctgcccatccctgaggttctcgacattggcgagttctctgagtccctcacctactgcatctctcgacgagctcagggagtcaccctgcaggacctccctgagactgagctgcctgctgtcctccagcctgttgctgaggccatggacgctatcgctgctgctgatctgtcccagacctcgggtttcggcccctttggacctcagggaattggacagtacaccacttggcgagacttcatctgtgctattgccgatcctcacgtctaccattggcagaccgttatggacgatactgtgtcggcttctgtcgctcaggctctggacgagctgatgctctgggccgaggattgccccgaggttcgacacctggtgcatgctgacttcggttccaacaacgttctcaccgacaacggccgaatcactgccgtgattgactggtccgaggctatgtttggcgactcgcagtacgaggtggccaacatcttcttttggcgaccctggctggcttgtatggagcagcagacccgatacttcgagcgacgacatcctgagctcgctggatcccctcgactgcgagcttacatgctccgaattggtctggaccagctctaccagtcgctggtggatggcaactttgacgatgct

SEQ ID NO: 161 - DNA, 633 bp, Yarrowia lipolytica
accacttggcgagacttcatctgtgctattgccgatcctcacgtctaccattggcagaccgttatggacgatactgtgtcggcttctgtcgctcaggctctggacgagctgatgctctgggccgaggattgccccgaggttcgacacctggtgcatgctgacttcggttccaacaacgttctcaccgacaacggccgaatcactgccgtgattgactggtccgaggctatgtttggcgactcgcagtacgaggtggccaacatcttcttttggcgaccctggctggcttgtatggagcagcagacccgatacttcgagcgacgacatcctgagctcgctggatcccctcgactgcgagcttacatgctccgaattggtctggaccagctctaccagtcgctggtggatggcaactttgacgatgctgcctgggctcagggacgatgtgacgccatcgtgcgatctggcgctggaaccgtcggacgaactcagattgcccgacgatccgctgctgtctggaccgacggatgcgtggaggtcctggctgattcgggtaaccgacgaccctctactcgacctcgagctaaggagtaaccccgagcagagcacataactactaacgatgagactaaa

SEQ ID NO: 162 - DNA, 908 bp, Yarrowia lipolytica
tcaatgtagacgtcgcggaacttctctttcctacccaccaccccaaacaaatgaagaagcccgagctgaccgctacctctgttgagaagttcctgattgagaagtttgattccgtttccgacctgatgcagctgtccgagggcgaggagtctcgagccttctcctttgacgtgggcggacgaggttacgttctgcgagtgaactcgtgtgccgacggcttctacaaggatcgatacgtctaccgacactttgcttctgccgctctgcccatccctgaggttctcgacattggcgagttctctgagtccctcacctactgcatctctcgacgagctcagggagtcaccctgcaggacctccctgagactgagctgcctgctgtcctccagcctgttgctgaggccatggacgctatcgctgctgctgatctgtcccagacctcgggtttcggcccctttggacctcagggaattggacagtacaccacttggcgagacttcatctgtgctattgccgatcctcacgtctaccattggcagaccgttatggacgatactgtgtcggcttctgtcgctcaggctctggacgagctgatgctctgggccgaggattgccccgaggttcgacacctggtgcatgctgacttcggttccaacaacgttctcaccgacaacggccgaatcactgccgtgattgactggtccgaggctatgtttggcgactcgcagtacgaggtggccaacatcttcttttggcgaccctggctggcttgtatggagcagcagacccgatacttcgagcgacgacatcctgagctcgctggatcccctcgactgcgagcttacatgctccgaattggtctggaccagctctaccagtcgctggtggatggcaactttgacgatgct

SEQ ID NO: 163 - DNA, 634 bp, Yarrowia lipolytica
accacttggcgagacttcatctgtgctattgccgatcctcacgtctaccattggcagaccgttatggacgatactgtgtcggcttctgtcgctcaggctctggacgagctgatgctctgggccgaggattgccccgaggttcgacacctggtgcatgctgacttcggttccaacaacgttctcaccgacaacggccgaatcactgccgtgattgactggtccgaggctatgtttggcgactcgcagtacgaggtggccaacatcttcttttggcgaccctggctggcttgtatggagcagcagacccgatacttcgagcgacgacatcctgagctcgctggatcccctcgactgcgagcttacatgctccgaattggtctggaccagctctaccagtcgctggtggatggcaactttgacgatgctgcctgggctcagggacgatgtgacgccatcgtgcgatctggcgctggaaccgtcggacgaactcagattgcccgacgatccgctgctgtctggaccgacggatgcgtggaggtcctggctgattcgggtaaccgacgaccctctactcgacctcgagctaaggagtaactgtatagtaaaagcgtatagccaataagataatcacttg

SEQ ID NO: 164 - protein, 918 aa, Arxula adeninivorans
MSSYSSGVDGGTAEPRNRALEKDNVVDNVVNDSRDQPSAEEMPRKSDKIYGKTPSGTVFAVPHTEDMVTNLLDPRVSKSISDVAIVSVLASYIALYLITPKSARIPVFLAMFGFWRLAYNAGIGLLLDGQSKTRMLTRLAQQYKLFDPSSKGWFVHELIRKDLTAKMDASEYDFYKSPLELNTWLLFRDLVDLILMSDFTCYMLLAMACSSKTDHPWFIVFGRWAAGISLFVFNLWVKLDAHRVVKDYAWYWGDFFFLEDVQLTFDGVFEMAPHPMYSIGYAGYYGICLMTASYTLFAASVLAHACQFAFLILVENPHIEKTYNPPKQPTRPRKISDVSGPSSPGGSVNGDEPASAAVFDDENAVMRSSQRPMLIFKGFTVTRASDILLVFMTLYYSILYFVPYNRFWNFVVFGTALGWRVFHNFGLGYLLSKQSESKAWTRVFLKFGHSPLYAYQQWQALYNASTVMSYVSFAVCAFRLWNSPIGLVPYWPFRYIIGAMLITLQIWTSYSIYESLGDYGWFYGDFFFPQPQKLTYSGIYRYLNNPERLFGIAGVWGTALLTTSLPVAILAFLWTFGGMAFIRFVEQPHMQKLYGGQLRNEAGVTKTIRQATKLAPPFESKVRQLQGSFDKVISETSEAVESFLGLSKTKRSLSGVKDVVNDTRVLLKQYPARLTIVRVSDDICADTSQYSLTISPESLVSSGAEDNGNSLKVEYGTPIRVKWTSDTNNTPADWIGLYRLTDNKSKEVTRISSRGRWVGLSKEAYDEDHTSGIVSRDGDTQGEVVFENEALFWERGVYEFRYHYNRKHNVLAISQPFEIVTGRRDISDHEQGLDTLANELLDLVQRCCKGTTVWAPTSPEDLWELNDKQAVSRLAYGVKEIYGIDLAPSVFQVDENVLQLATRLVKVKKALQPFDLKA

SEQ ID NO: 165 - DNA, 2757 bp, Arxula adeninivorans
atgtcttcttactcctctggagtggacggcggaacagcagagcctcggaacagagctctggagaaggacaatgtcgtggacaatgtcgtgaacgactcgagggatcaaccctcggccgaggaaatgccccgcaagagtgacaagatctatggaaagacaccctcgggaactgtgtttgcggttcctcataccgaggatatggtgacaaacttgctggatccccgagtgtcaaagtccatttccgatgttgccattgtgtcggtgctggcgtcgtatattgcgttgtacctgattactcctaagagcgcccgtatccctgtattcctggccatgtttgggttctggcgactggcgtacaacgcgggaattggactgctgttggacggtcagtccaagactcgcatgctcactcgtctggctcagcagtacaagctgtttgatccctccagcaagggatggtttgttcacgagttgatccgcaaggacctgaccgctaaaatggacgcaagcgagtacgatttctacaagagtcctttggaacttaacacctggctgcttttcagagacttggttgacctgattctcatgagcgactttacctgctacatgctgctggcaatggcatgctcttcaaagaccgaccacccttggttcattgtatttggtcgatgggccgcgggaatctctctgtttgtgttcaacttgtgggtcaagcttgatgctcaccgagttgtcaaggattatgcgtggtactggggagatttcttcttcctcgaggatgttcaattgacctttgacggtgtgtttgagatggctcctcatccaatgtactctattggctatgccggatactacggaatttgtctcatgactgcctcgtacactctgtttgctgcctccgtgttggctcacgcttgccagtttgccttcctcatcctggtagagaacccccatattgaaaagacttacaaccctcccaagcagcccactcggccacgaaagatctcggacgtgtctggcccctccagtcctggcggatctgttaacggcgatgagccggcttctgctgcagtgtttgacgatgagaatgcggtcatgcgtagcagccagagacctatgctcattttcaagggcttcactgttactcgagcttcggatattctgttagtgtttatgactctctactactcaatcttgtactttgtcccctacaaccgattctggaactttgtggtgtttggaaccgcccttggctggagagtgttccacaactttggcctgggctacctgttgtccaagcagtctgaatccaaggcatggactagggtgttcctcaagtttggtcactcgcccttgtatgcctaccagcagtggcaggctctgtacaacgctagcacagtcatgtcctatgttagctttgcggtatgcgcctttcgattgtggaactcccctattggcctggtcccttactggcccttccgatacattattggtgcaatgctaattacgcttcagatttggacctcgtactccatctatgagtctctgggagattatggatggttctacggagactttttcttcccccagcctcaaaagctcacctactctggaatctaccgctacctcaacaacccagagcgattgtttggaattgctggcgtctggggtactgctttgttgaccaccagcttgcccgtcgctattctcgccttcttgtggacttttggaggaatggcctttatccgctttgtcgagcaaccccatatgcaaaagctgtacggaggtcagctccgtaacgaggccggagttacaaagaccattcgtcaggctaccaagctggctcctccatttgagtccaaggttcgtcagctccaaggatcatttgacaaggtcatttctgagacgagtgaagcagtcgagtcatttttgggtctcagcaagaccaagcgatccctgtctggtgtgaaggatgttgtcaatgacactcgggttctgctcaagcagtatcctgctcgactgaccattgtgcgagtgagtgatgatatctgtgctgatacctctcaatactctctgaccattagtcctgaaagcctggttagcagtggagcagaagacaatggcaatagtctcaaggttgaatacggtactcccattcgagtcaagtggacttctgacacaaacaacactcctgctgactggattggtttgtatagactgactgacaacaagtcaaaggaggtcactcgaatctcgtcccgtggccgatgggtaggattgagtaaggaagcttatgatgaagaccacactagtggcattgtatctcgggacggtgatactcagggagaggtcgttttcgagaacgaggccttattctgggaacgaggtgtctacgagttccgttatcactataaccgcaagcacaatgtgctggccatttcgcagccctttgagattgtcactggtcgtcgggatatcagcgatcacgaacagggtcttgacacccttgctaatgagttactggacctggtccaaagatgctgcaagggtactactgtatgggcccctacttcgccggaagatctgtgggaacttaacgacaagcaagcagtttctcgattagcatacggagttaaagaaatttatggaattgacctggctccgtccgtgttccaggtggacgaaaatgtcctgcaattggccactcggttagtcaaggtcaagaaggctctacaaccatttgacctcaaggcgtag

SEQ ID NO: 166 - protein, 710 aa, Arxula adeninivorans; identical to SEQ ID NO: 47

SEQ ID NO: 167 - DNA, 2133 bp, Arxula adeninivorans; identical to SEQ ID NO: 48

SEQ ID NO: 168 - protein, 579 aa, Arxula adeninivorans
MALGVFIQLAEEGSRMTGIPPDLLRLAFCLVFSYPGCAILKRLPDNNTLVKELFIMSVSLFYLLGVFSMWGGVRTLLISTLATYYITKKWPSSPFMPWANFLFVMAHLFTNHIANQIKEAGELYDPNVIDITGAQMVLCMKLSAFGWNVYDGTQPQGSLSDFQKMRAVKKHPSLLDFVTYAFFFPSVLTGPSFDYEEFRQWIDLSMFDVTANDPKRGRAVNRKIPRSGRVATLKALEGVLWIVVWVLVTSYFNLDYALSPKFTSELNFVLKMLYLYVLGFSYRLKYYGAWSISEGSCILAGIGFNGKTKSGKYKWDRVKNIDPWKFEFGQNTFTLLEAWNMNTNKWLKNYVYLRVTPKGKKPGFRSTLATFFTSAFWHGTRPGYYLTFVTGAFFQALGKIFRRNLRPIFLEADGVTPGPYKKYYDILTWVTVQLGFGYMVQPFMILEFGPSLRLWSTVYFCVHLFIALVILLFYGPYKRTVTGYLNSLRPKETTIKPADKLKMDAEKLRQLQHELRVLSSNEPSLGVPQPDFEDFDDDVKEAIAEFEALKNEIARDIDALRPKVDKEPLKNAKPQSKRQ

SEQ ID NO: 169 - DNA, 1740 bp, Arxula adeninivorans
atggcgctcggggtatttattcagctggccgaggaggggtctcggatgacgggaattcctcctgatttgctgcggttggcgttttgtctagtattctcctacccaggatgtgccattcttaagcggttacctgataacaacactcttgtcaaagagctgttcatcatgtcagtgtctcttttctacttgcttggagtattcagcatgtggggcggagtgagaacgctgcttatcagcacattggcgacctattatatcacaaaaaagtggccgtcttccccgtttatgccttgggctaacttccttttcgtcatggcacacttgttcacaaaccacattgccaatcagattaaagaggctggcgaattgtatgaccccaatgtcattgacatcaccggggcacagatggtgctttgtatgaagctttcggcatttgggtggaacgtgtacgacggcacacagccacaggggtcgctgtcggatttccaaaagatgcgggctgtcaagaagcacccatctctattagattttgtcacgtatgcttttttctttccttcagtgcttacgggcccttcgtttgactacgaagagtttaggcaatggattgacctgtcaatgtttgacgttactgctaatgatcccaagcgaggacgggccgtcaatcgtaaaattccccgtagtggaagagtagccaccctcaaagcactggagggagtgttatggattgtggtgtgggttctagtcacgtcctactttaatctcgactatgcgctgtcgccaaagtttacctccgagctcaatttcgtcttgaaaatgctatacctctatgttctgggattctcgtacagactcaagtattatggtgcttggtccatttccgagggctcgtgcatcttggccggcattgggttcaacggaaagacaaaatctggaaagtacaaatgggatcgtgttaagaacattgacccttggaagtttgagtttggccaaaacacgtttacccttctggaggcttggaatatgaatacaaacaagtggctcaagaattatgtctatttgcgagtcactccaaagggtaaaaagccaggcttccgtagtactctggccaccttttttacgtcggccttttggcatggtaccaggcctgggtattacttgacgtttgtgactggtgcttttttccaggccctaggtaaaatatttagacgcaacctccgtccaattttcctggaagctgatggagttacccctggaccctataaaaagtactacgatattctgacttgggtcacggtgcagctaggctttggatacatggttcaaccgtttatgatcctagagtttggaccctctcttagactttggtctacggtctacttttgcgtccaccttttcatcgctcttgtcattcttctcttttatggaccgtacaagcgtactgttaccggatacctcaattctttacgaccgaaggagaccaccattaagcccgccgacaagctcaagatggatgctgaaaagcttcgccagctccaacacgagctacgagtgttgtcttcaaacgagccttctttgggagttcctcagcccgattttgaagattttgacgacgacgtcaaggaagcaattgccgaatttgaagcgctcaagaatgaaattgctcgggacattgacgccctgcgaccaaaggtcgacaaggagcctctcaagaacgcaaagccacagagcaaacgacagtaa

SEQ ID NO: 170 - protein, 280 aa, Arxula adeninivorans
MEKFSNWRDGATGVAPFLPLPKPESSPAGTACGLILGLIRLPLVIVLTIFHFLLFQWLGPLNAVSIRLILMVLGVYRVSTVLENKRAPTPGKGDIIVSNFTSPLDPLIYSVLFDPLFVIPDGNARFLALSMPGAFRQALSVPTIGQGPSAGHDLAKLVDRARASGKLLVIFAEGTTTNGRGLLAIPDKGTPISNTATGRVYASAVRYNPPRGCSPVPQTAVRWVWGLVSCTGVNCTVRMSAPVEGKQTVAESICRVGRLRQLGLSANDKVDFYQAWKKYH

SEQ ID NO: 171 - DNA, 1025 bp, Arxula adeninivorans
atggagaagttttccaactggcgagacggcgctacgggcgtggcaccatttttaccgttgccaaagccagaatcttcaccggcaggcacagcatgtggactgattttgggcctgatccggctacctctggtgattgttttgacgatatttcactttctcctgtttcaatggctggggccattgaatgcggtgtcaattcgattgatactcatggtcttaggagtatacagagtttcgacagtgctcgagaacaaacggtaaggtttcttattgcccccaagacctacagatcatactaattgtgatcttgtcacggtcctagagcccttccctagagccctaatactaactaatagtgcaccaactcctggcaaaggagacattatcgtatccaatttcacgtccccattggaccctctaatctattcagtattgtaagtacagtacagtacagccccctttctcctgtctccagacagctggcaaatggcacatgctatacaaggttactaactaggtttgaccccctgtttgtcattcctgatggaaatgcgagatttctggccctgtcaatgccgggtgcgttccgacaagcattaagcgttccaaccatcggtcagggaccatctgcaggacacgacctggctaagctagtcgatcgcgccagggcatccggaaagctcttggtgatcttcgccgaaggcaccaccacgaacggccggggcctcctggcaatcccagacaaaggcaccccaatctcgaacaccgcgactggacgcgtatatgcatcggcggtacggtataatccccctcgaggatgctctcctgtgccccagaccgcggtacgatgggtgtggggattagtgtcttgcactggcgtcaattgcaccgtccggatgtctgctccagtggagggcaagcaaaccgttgccgagagtatctgtcgggttggccgcctccgtcagctcggactatctgcaaacgacaaggtagatttttaccaagcttggaaaaagtaccactaa

SEQ ID NO: 172 - protein, 280 aa, Arxula adeninivorans; identical to SEQ ID NO: 170

SEQ ID NO: 173 - DNA, 843 bp, Arxula adeninivorans
atggagaagttttccaactggcgagacggcgctacgggcgtggcaccatttttaccgttgccaaagccagaatcttcaccggcaggcacagcatgtggactgattttgggcctgatccggctacctctggtgattgttttgacgatatttcactttctcctgtttcaatggctggggccattgaatgcggtgtcaattcgattgatactcatggtcttaggagtatacagagtttcgacagtgctcgagaacaaacgtgcaccaactcctggcaaaggagacattatcgtatccaatttcacgtccccattggaccctctaatctattcagtattgtttgaccccctgtttgtcattcctgatggaaatgcgagatttctggccctgtcaatgccgggtgcgttccgacaagcattaagcgttccaaccatcggtcagggaccatctgcaggacacgacctggctaagctagtcgatcgcgccagggcatccggaaagctcttggtgatcttcgccgaaggcaccaccacgaacggccggggcctcctggcaatcccagacaaaggcaccccaatctcgaacaccgcgactggacgcgtatatgcatcggcggtacggtataatccccctcgaggatgctctcctgtgccccagaccgcggtacgatgggtgtggggattagtgtcttgcactggcgtcaattgcaccgtccggatgtctgctccagtggagggcaagcaaaccgttgccgagagtatctgtcgggttggccgcctccgtcagctcggactatctgcaaacgacaaggtagatttttaccaagcttggaaaaagtaccactaa

SEQ ID NO: 174 - protein, 198 aa, Arxula adeninivorans
MDSVAKVAEVARIDLTQDSLKCTYTLLDNTNSAEYKTKVLTKIAGSPKSGCYMLALTIFSLGIFRDYLYELALRDQPTCVYLNTIYGKVAGAVLFACGNVLVLTSMWALGITGTYLGDYFGILMDHRVTSFPFNVSNNPMYHGSTLSFLGTALWFAKPAGIAISVFVFVMYSIALVFEEPFTAEIYAKRDRERAKKAN

SEQ ID NO: 175 - DNA, 722 bp, Arxula adeninivorans
atggactcggtagcaaaggttgcagaggttgctcgaattgacctcactcaggactccctcaagtgtacgtatacggtatggagttaattcaactcaagttgctaacccaggggtgttggcctcggtcgcctttaatccaatcttctggaacattgtcgccagactaggtatgctatatgaaggacttgatggttcattagttattggacaatactaacagcgcagagtacaagaccaaggtactgactaagattgccggaagccctaagtcaggatgttacatgcttgctctgaccatcttctcgttgggaattttcagagattacctttatgagctcgctcttcgcgaccagcctacttgcgtgtatttgaacacaatttacggcaaggtggcaggagcagtactgttcgcatgtggaaacgtgttggtcctaacatccatgtgggctcttggaatcactggaacttacctgggtgactatttcggaattctcatggaccaccgagtgacttcgttccctttcaatgtctccaacaacccaatgtaccacggaagcactctatctttccttggaactgccctgtggtttgccaagcctgctggaattgccatctcggtgtttgtgtttgtcatgtactccattgctctagtatttgaggagccattcacagccgagatctacgctaagcgagatcgcgagagagccaagaaggccaactaa

SEQ ID NO: 176 - protein, 198 aa, Arxula adeninivorans; identical to SEQ ID NO: 174

SEQ ID NO: 177 - DNA, 597 bp, Arxula adeninivorans
atggactcggtagcaaaggttgcagaggttgctcgaattgacctcactcaggactccctcaagtgtacgtatacgttattggacaatactaacagcgcagagtacaagaccaaggtactgactaagattgccggaagccctaagtcaggatgttacatgcttgctctgaccatcttctcgttgggaattttcagagattacctttatgagctcgctcttcgcgaccagcctacttgcgtgtatttgaacacaatttacggcaaggtggcaggagcagtactgttcgcatgtggaaacgtgttggtcctaacatccatgtgggctcttggaatcactggaacttacctgggtgactatttcggaattctcatggaccaccgagtgacttcgttccctttcaatgtctccaacaacccaatgtaccacggaagcactctatctttccttggaactgccctgtggtttgccaagcctgctggaattgccatctcggtgtttgtgtttgtcatgtactccattgctctagtatttgaggagccattcacagccgagatctacgctaagcgagatcgcgagagagccaagaaggccaactaa

SEQ ID NO: 178 - protein, 165 aa, Arxula adeninivorans
MDDFSAQLDSHQVPGQGGSFQDGAGAESNLGFGMPEGMDATSAPQDKRSSSASARRRSDNGAVKASAGRVQKAPGELLTPEEKKANHIASEKKRRQAIREGFDKITNIVPDLDPSQGRSEAIVLTKTVEFLNNLLEENNALRQLATKHNVPLSTPLPDMNDTKDK

SEQ ID NO: 179 - DNA, 498 bp, Arxula adeninivorans
atggacgacttttctgcacaattagattcccaccaggttcccggtcagggaggatcgttccaggatggcgctggcgcagagtccaacttggggtttggcatgcctgaagggatggacgcgacctcagcacctcaggacaagcggtcctcgtctgcgtcagctagaaggcgatccgacaacggggcggtcaaggccagcgctggccgggttcagaaggctccaggcgagctgctgacccctgaagagaagaaggccaaccatatagcatcagaaaagaagcgacgccaggccattcgtgaagggttcgataagatcacaaacattgtccctgatttagatccatcccagggtcgatcagaggctattgttctgaccaagacggtggagtttttgaacaatctgctggaggagaataacgctcttcgtcagttggccacaaagcacaacgttccgctgtccaccccgcttcctgacatgaacgacaccaaggataaataa

What is claimed is:

1. A recombinant cell comprising an exogenous nucleic acid molecule comprising a nucleotide sequence comprising at least 70% sequence homology with SEQ ID NO: 16 or 18.

2. The recombinant cell of claim 1, wherein the nucleotide sequence comprises at least 80% sequence homology with SEQ ID NO: 16 or 18.

3. The recombinant cell of claim 1, wherein said cell is selected from the group consisting of algae, bacteria, molds, fungi, plants, and yeasts.

4. The recombinant cell of claim 3, wherein said cell is selected from the group consisting of *Arxula, Aspergillus, Aurantiochytrium, Candida, Claviceps, Cryptococcus, Cunninghamella, Geotrichum, Hansenula, Kluyveromyces, Kodamaea, Leucosporidiella, Lipomyces, Mortierella, Ogataea, Pichia, Prototheca, Rhizopus, Rhodosporidium, Rhodotorula, Saccharomyces, Schizosaccharomyces, Tremella, Trichosporon, Wickerhamomyces*, and *Yarrowia*.

5. The recombinant cell of claim 4, wherein said cell is selected from the group consisting of *Arxula adeninivorans, Aspergillus niger, Aspergillus oryzae, Aspergillus terreus, Aurantiochytrium limacinum, Candida utilis, Claviceps purpurea, Cryptococcus albidus, Cryptococcus curvatus, Cryptococcus ramirezgomezianus, Cryptococcus terreus, Cryptococcus wieringae, Cunninghamella echinulata, Cunninghamella japonica, Geotrichum fermentans, Hansenula polymorpha, Kluyveromyces lactis, Kluyveromyces marxianus, Kodamaea ohmeri, Leucosporidiella creatinivora, Lipomyces hpofer, Lipomyces starkeyi, Lipomyces tetrasporus, Mortierella isabellina, Mortierella alpina, Ogataea polymorpha, Pichia ciferrii, Pichia guilliermondii, Pichia pastoris, Pichia stipites, Prototheca zopfii, Rhizopus arrhizus, Rhodosporidium babjevae, Rhodosporidium toruloides, Rhodosporidium paludigenum, Rhodotorula glutinis, Rhodotorula mucilaginosa, Saccharomyces cerevisiae, Schizosaccharomyces pombe, Tremella enchepala, Trichosporon cutaneum, Trichosporon fermentans, Wickerhamomyces ciferrii*, and *Yarrowia lipolytica*.

6. The recombinant cell of claim 5, wherein said cell is *Yarrowia lipolytica* or *Arxula adeninivorans*.

7. The recombinant cell of claim 1, wherein the recombinant cell comprises at least two copies of the exogenous nucleotide molecule.

8. The recombinant cell of claim 2, wherein the recombinant cell comprises at least two copies of the exogenous nucleotide molecule.

* * * * *